United States Patent 10,463,711 (NUTRITIVE POLYPEPTIDES AND FORMULATIONS THEREOF, AND METHODS OF PRODUCTION AND USE THEREOF) - sequence listing, part 3

SEQ ID NO: 9717 - protein, 662 aa, Escherichia coli DEC12C
MVPSTFSRLKAARCLPVVLAALIFAGCGTHTPDQSTAYMQGTTQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGHTIQQGFEAAKNIGTQPVAAQVAAAPAADVAEQPQPQTVDGVASPAQASVSDLTGEQPAAQPAPVSTPAATTTAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 9718 - protein, 386 aa, Escherichia coli DEC12C; identical to SEQ ID NO: 7908

SEQ ID NO: 9719 - protein, 208 aa, Escherichia coli DEC12C; identical to SEQ ID NO: 5717

SEQ ID NO: 9720 - protein, 614 aa, Escherichia coli DEC12C; identical to SEQ ID NO: 7971

SEQ ID NO: 9721 - protein, 237 aa, Escherichia coli DEC12C; identical to SEQ ID NO: 6384

SEQ ID NO: 9722 - protein, 478 aa, Escherichia coli DEC12C; identical to SEQ ID NO: 8471

SEQ ID NO: 9723 - protein, 368 aa, Escherichia coli DEC12C; identical to SEQ ID NO: 8468

SEQ ID NO: 9724 - protein, 121 aa, Escherichia coli DEC12C
MNVKAIPSMDKSKLTENTLQLAIISRIKLYYRPAKLALPLDQAAEKLRFRRSANSLTLINPTPYYLTVTELNAGTRVLENALVPPMGESTVKLPSDAGSNITYRTINDYGALTPKMTGVME

SEQ ID NO: 9725 - protein, 856 aa, Escherichia coli DEC12C; identical to SEQ ID NO: 9540

SEQ ID NO: 9726 - protein, 784 aa, Escherichia coli DEC12D; identical to SEQ ID NO: 6283

SEQ ID NO: 9727 - protein, 170 aa, Escherichia coli DEC12D [sequence omitted]

SEQ ID NO: 9728 - protein, 765 aa, Escherichia coli DEC12D; identical to SEQ ID NO: 9418

SEQ ID NO: 9729 - protein, 198 aa, Escherichia coli DEC12D
MCIYLNLMILIKIIRGFISAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVTGLNGKASSAKVHFYAINDFGGAIEGNASL

SEQ ID NO: 9730 - protein, 747 aa, Escherichia coli DEC12D; identical to SEQ ID NO: 6343

SEQ ID NO: 9731 - protein, 266 aa, Escherichia coli DEC12D; identical to SEQ ID NO: 5772

SEQ ID NO: 9732 - protein, 161 aa, Escherichia coli DEC12D; identical to SEQ ID NO: 5769

SEQ ID NO: 9733 - protein, 351 aa, Escherichia coli DEC12D; identical to SEQ ID NO: 5767

SEQ ID NO: 9734 - protein, 230 aa, Escherichia coli DEC12D; identical to SEQ ID NO: 6294

SEQ ID NO: 9735 - protein, 421 aa, Escherichia coli DEC12D
MKIPTTTDIPQRYTWCLAGICYSSLAILLSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNRLC

SEQ ID NO: 9736 - protein, 365 aa, Escherichia coli DEC12D; identical to SEQ ID NO: 7931

SEQ ID NO: 9737 - protein, 746 aa, Escherichia coli DEC12D
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYVTTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSQQAREDLSMQTTFTWYGKQQPKKYNYKGQPAVGPETKEISPYSIVGLSATWDVTKNVSLTGGVDNLFDKRLWRAGNAQTTGDLARANYIAGAGAYTYNEPGRTWYMSVNTHF

SEQ ID NO: 9738 - protein, 193 aa, Escherichia coli DEC12D; identical to SEQ ID NO: 6300

SEQ ID NO: 9739 - protein, 243 aa, Escherichia coli DEC12D; identical to SEQ ID NO: 6463

SEQ ID NO: 9740 - protein, 657 aa, Escherichia coli DEC12D
MDYNLFASSYRPQDGSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYTLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 9741 - protein, 430 aa, Escherichia coli DEC12D; identical to SEQ ID NO: 5758

SEQ ID NO: 9742 - protein, 760 aa, Escherichia coli DEC12D; identical to SEQ ID NO: 6455

SEQ ID NO: 9743 - protein, 203 aa, Escherichia coli DEC12D; identical to SEQ ID NO: 6414

SEQ ID NO: 9744 - protein, 361 aa, Escherichia coli DEC12D; identical to SEQ ID NO: 7868

SEQ ID NO: 9745 - protein, 204 aa, Escherichia coli DEC12D; identical to SEQ ID NO: 9560

SEQ ID NO: 9746 - protein, 851 aa, Escherichia coli DEC12D; identical to SEQ ID NO: 9233

SEQ ID NO: 9747 - protein, 226 aa, Escherichia coli DEC12D; identical to SEQ ID NO: 7934

SEQ ID NO: 9748 - protein, 191 aa, Escherichia coli DEC12D; identical to SEQ ID NO: 5748

SEQ ID NO: 9749 - protein, 232 aa, Escherichia coli DEC12D; identical to SEQ ID NO: 5747

SEQ ID NO: 9750 - protein, 729 aa, Escherichia coli DEC12D; identical to SEQ ID NO: 5745

SEQ ID NO: 9751 - protein, 213 aa, Escherichia coli DEC12D; identical to SEQ ID NO: 5744

SEQ ID NO: 9752 - protein, 203 aa, Escherichia coli DEC12D; identical to SEQ ID NO: 6347

SEQ ID NO: 9753 - protein, 565 aa, Escherichia coli DEC12D
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRRMDNPHQLNTLRTTSIVPVDLNSLMFKMEKILARASKAAGDNAMANQYETLANARQKGIEKYMWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 9754 - protein, 207 aa, Escherichia coli DEC12D; identical to SEQ ID NO: 5743

SEQ ID NO: 9755 - protein, 539 aa, Escherichia coli DEC12D; identical to SEQ ID NO: 6525

SEQ ID NO: 9756 - protein, 550 aa, Escherichia coli DEC12D
MKIFSVRQTVLPALLVLSPVVFAADEQTMIVSAAPQVVSELDTPAAVSVVDGEEMRLATSRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRAGR

SEQ ID NO: 9757 - protein, 236 aa, Escherichia coli DEC12D; identical to SEQ ID NO: 7814

SEQ ID NO: 9758 - protein, 111 aa, Escherichia coli DEC12D; identical to SEQ ID NO: 8460

SEQ ID NO: 9759 - protein, 118 aa, Escherichia coli DEC12D [sequence omitted]

SEQ ID NO: 9760 - protein, 826 aa, Escherichia coli DEC12D; identical to SEQ ID NO: 8499

SEQ ID NO: 9761 - protein, 224 aa, Escherichia coli DEC12D; identical to SEQ ID NO: 6435

SEQ ID NO: 9762 - protein, 641 aa, Escherichia coli DEC12D; identical to SEQ ID NO: 9641

SEQ ID NO: 9763 - protein, 162 aa, Escherichia coli DEC12D; identical to SEQ ID NO: 6365

SEQ ID NO: 9764 - protein, 367 aa, Escherichia coli DEC12D; identical to SEQ ID NO: 5784

SEQ ID NO: 9765 - protein, 200 aa, Escherichia coli DEC12D; identical to SEQ ID NO: 6311

SEQ ID NO: 9766 - protein, 274 aa, Escherichia coli DEC12D; identical to SEQ ID NO: 8357

SEQ ID NO: 9767 - protein, 250 aa, Escherichia coli DEC12D; identical to SEQ ID NO: 6317

SEQ ID NO: 9768 - protein, 861 aa, Escherichia coli DEC12D
MSGSYSSVWAEDDIQFDSRFLELKGDTKIDLKRFSSQGYVEPGKYNLQVQLNKQPLAEEYDIYWYAGEDDASKSYACLTPELVAQFGLKEDVANNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 9769 - protein, 518 aa, Escherichia coli DEC12D; identical to SEQ ID NO: 6358

SEQ ID NO: 9770 - protein, 432 aa, Escherichia coli DEC12D; identical to SEQ ID NO: 5727

SEQ ID NO: 9771 - protein, 359 aa, Escherichia coli DEC12D; identical to SEQ ID NO: 6332

SEQ ID NO: 9772 - protein, 834 aa, Escherichia coli DEC12D
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIFEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASDSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 9773 - protein, 249 aa, Escherichia coli DEC12D; identical to SEQ ID NO: 6450

SEQ ID NO: 9774 - protein, 231 aa, Escherichia coli DEC12D; identical to SEQ ID NO: 6351

SEQ ID NO: 9775 - protein, 721 aa, Escherichia coli DEC12D; identical to SEQ ID NO: 9331

SEQ ID NO: 9776 - protein, 662 aa, Escherichia coli DEC12D; identical to SEQ ID NO: 8481

SEQ ID NO: 9777 - protein, 412 aa, Escherichia coli DEC12D; identical to SEQ ID NO: 6495

SEQ ID NO: 9778 - protein, 208 aa, Escherichia coli DEC12D; identical to SEQ ID NO: 5717

SEQ ID NO: 9779 - protein, 614 aa, Escherichia coli DEC12D; identical to SEQ ID NO: 7971

SEQ ID NO: 9780 - protein, 446 aa, Escherichia coli DEC12D; identical to SEQ ID NO: 8470

SEQ ID NO: 9781 - protein, 478 aa, Escherichia coli DEC12D; identical to SEQ ID NO: 8471

SEQ ID NO: 9782 - protein, 512 aa, Escherichia coli DEC12D; identical to SEQ ID NO: 6251

SEQ ID NO: 9783 - protein, 774 aa, Escherichia coli DEC12D; identical to SEQ ID NO: 8469

SEQ ID NO: 9784 - protein, 368 aa, Escherichia coli DEC12D; identical to SEQ ID NO: 8468

SEQ ID NO: 9785 - protein, 241 aa, Escherichia coli DEC12D; identical to SEQ ID NO: 6143

SEQ ID NO: 9786 - protein, 863 aa, Escherichia coli DEC12D; identical to SEQ ID NO: 8466

SEQ ID NO: 9787 - protein, 784 aa, Escherichia coli DEC12E; identical to SEQ ID NO: 6283

SEQ ID NO: 9788 - protein, 170 aa, Escherichia coli DEC12E
MSGILTRWRQFGKRYFWPHLLLGMVAASLGLPALSNAAEPNAPAKATTRNHEPSAKVNFGQLALLEANTRRPNSNYSVDYWHQHAIRMVIRHLSFAMAPQTLPVAEESLPLQAQHLALLDTLSALLTQEGTPSEKGYRIDYAHFTPQAKFSTPVWISQAQGIRAGPQRLT

SEQ ID NO: 9789 - protein, 765 aa, Escherichia coli DEC12E; identical to SEQ ID NO: 9418

SEQ ID NO: 9790 - protein, 230 aa, Escherichia coli DEC12E; identical to SEQ ID NO: 9544

SEQ ID NO: 9791 - protein, 368 aa, Escherichia coli DEC12E; identical to SEQ ID NO: 8468

SEQ ID NO: 9792 - protein, 241 aa, Escherichia coli DEC12E; identical to SEQ ID NO: 6143

SEQ ID NO: 9793 - protein, 856 aa, Escherichia coli DEC12E; identical to SEQ ID NO: 9540

SEQ ID NO: 9794 - protein, 747 aa, Escherichia coli DEC12E; identical to SEQ ID NO: 6343

SEQ ID NO: 9795 - protein, 266 aa, Escherichia coli DEC12E; identical to SEQ ID NO: 5772

SEQ ID NO: 9796 - protein, 161 aa, Escherichia coli DEC12E; identical to SEQ ID NO: 5769

SEQ ID NO: 9797 - protein, 365 aa, Escherichia coli DEC12E; identical to SEQ ID NO: 7931

SEQ ID NO: 9798 - protein, 230 aa, Escherichia coli DEC12E
MMTKIKLLMLIIFYLIISASAHAAGGIALGATRIIYPADAKQTAVWIRNSHTKERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVSSQIPLPSGVQGKLKFQTVNDYGSVTPVREVNLN

SEQ ID NO: 9799 - protein, 820 aa, Escherichia coli DEC12E; identical to SEQ ID NO: 9222

SEQ ID NO: 9800 - protein, 746 aa, Escherichia coli DEC12E; identical to SEQ ID NO: 8482

SEQ ID NO: 9801 - protein, 193 aa, Escherichia coli DEC12E; identical to SEQ ID NO: 6300

SEQ ID NO: 9802 - protein, 243 aa, Escherichia coli DEC12E; identical to SEQ ID NO: 6463

SEQ ID NO: 9803 - protein, 658 aa, Escherichia coli DEC12E; identical to SEQ ID NO: 9554

SEQ ID NO: 9804 - protein, 430 aa, Escherichia coli DEC12E; identical to SEQ ID NO: 5758

SEQ ID NO: 9805 - protein, 331 aa, Escherichia coli DEC12E; identical to SEQ ID NO: 6456

SEQ ID NO: 9806 - protein, 760 aa, Escherichia coli DEC12E; identical to SEQ ID NO: 6455

SEQ ID NO: 9807 - protein, 203 aa, Escherichia coli DEC12E; identical to SEQ ID NO: 6414

SEQ ID NO: 9808 - protein, 49 aa, Escherichia coli DEC12E
MNYFEVGATYYFNKNMSTYVDYIINQIDSDNKLGVGSDDTVAVGIVYQF

SEQ ID NO: 9809 - protein, 204 aa, Escherichia coli DEC12E; identical to SEQ ID NO: 9560

SEQ ID NO: 9810 - protein, 591 aa, Escherichia coli DEC12E; identical to SEQ ID NO: 9368

SEQ ID NO: 9811 - protein, 226 aa, Escherichia coli DEC12E; identical to SEQ ID NO: 7934

SEQ ID NO: 9812 - protein, 191 aa, Escherichia coli DEC12E; identical to SEQ ID NO: 5748

SEQ ID NO: 9813 - protein, 232 aa, Escherichia coli DEC12E; identical to SEQ ID NO: 5747

SEQ ID NO: 9814 - protein, 729 aa, Escherichia coli DEC12E; identical to SEQ ID NO: 5745

SEQ ID NO: 9815 - protein, 213 aa, Escherichia coli DEC12E; identical to SEQ ID NO: 5744

SEQ ID NO: 9816 - protein, 203 aa, Escherichia coli DEC12E; identical to SEQ ID NO: 6347

SEQ ID NO: 9817 - protein, 565 aa, Escherichia coli DEC12E; identical to SEQ ID NO: 6492

SEQ ID NO: 9818 - protein, 207 aa, Escherichia coli DEC12E; identical to SEQ ID NO: 5743

SEQ ID NO: 9819 - protein, 551 aa, Escherichia coli DEC12E; identical to SEQ ID NO: 5742

SEQ ID NO: 9820 - protein, 700 aa, Escherichia coli DEC12E; identical to SEQ ID NO: 9243

SEQ ID NO: 9821 - protein, 111 aa, Escherichia coli DEC12E; identical to SEQ ID NO: 8460

SEQ ID NO: 9822 - protein, 351 aa, Escherichia coli DEC12E; identical to SEQ ID NO: 5767

SEQ ID NO: 9823 - protein, 118 aa, Escherichia coli DEC12E [sequence omitted]

SEQ ID NO: 9824 - protein, 774 aa, Escherichia coli DEC12E; identical to SEQ ID NO: 8469

SEQ ID NO: 9825 - protein, 514 aa, Escherichia coli DEC12E; identical to SEQ ID NO: 9000

SEQ ID NO: 9826 - protein, 826 aa, Escherichia coli DEC12E; identical to SEQ ID NO: 8499

SEQ ID NO: 9827 - protein, 224 aa, Escherichia coli DEC12E; identical to SEQ ID NO: 6435

SEQ ID NO: 9828 - protein, 641 aa, Escherichia coli DEC12E
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLSLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGLETELKIPFNDEWKLSINYIYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 9829 - protein, 162 aa, Escherichia coli DEC12E; identical to SEQ ID NO: 6365

SEQ ID NO: 9830 - protein, 367 aa, Escherichia coli DEC12E; identical to SEQ ID NO: 5784

SEQ ID NO: 9831 - protein, 200 aa, Escherichia coli DEC12E; identical to SEQ ID NO: 6311

SEQ ID NO: 9832 - protein, 274 aa, Escherichia coli DEC12E; identical to SEQ ID NO: 8357

SEQ ID NO: 9833 - protein, 250 aa, Escherichia coli DEC12E; identical to SEQ ID NO: 6317

SEQ ID NO: 9834 - protein, 880 aa, Escherichia coli DEC12E; identical to SEQ ID NO: 6482

SEQ ID NO: 9835 - protein, 518 aa, Escherichia coli DEC12E; identical to SEQ ID NO: 6358

SEQ ID NO: 9836 - protein, 359 aa, Escherichia coli DEC12E; identical to SEQ ID NO: 6332

SEQ ID NO: 9837 - protein, 432 aa, Escherichia coli DEC12E; identical to SEQ ID NO: 5727

SEQ ID NO: 9838 - protein, 834 aa, Escherichia coli DEC12E; identical to SEQ ID NO: 9652

SEQ ID NO: 9839 - protein, 249 aa, Escherichia coli DEC12E; identical to SEQ ID NO: 6450

SEQ ID NO: 9840 - protein, 231 aa, Escherichia coli DEC12E; identical to SEQ ID NO: 6351

SEQ ID NO: 9841 - protein, 838 aa, Escherichia coli DEC12E; identical to SEQ ID NO: 9266

SEQ ID NO: 9842 - protein, 662 aa, Escherichia coli DEC12E; identical to SEQ ID NO: 8481

SEQ ID NO: 9843 - protein, 412 aa, Escherichia coli DEC12E; identical to SEQ ID NO: 6495

SEQ ID NO: 9844 - protein, 208 aa, Escherichia coli DEC12E; identical to SEQ ID NO: 5717

SEQ ID NO: 9845 - protein, 614 aa, Escherichia coli DEC12E; identical to SEQ ID NO: 7971

SEQ ID NO: 9846 - protein, 446 aa, Escherichia coli DEC12E; identical to SEQ ID NO: 8470

SEQ ID NO: 9847 - protein, 478 aa, Escherichia coli DEC12E; identical to SEQ ID NO: 8471

SEQ ID NO: 9848 - protein, 112 aa, Escherichia coli DEC12E
MLLRPSKKKSFFSKFTRLNMLRLARAVIPAAVLMMFFPQLAMAAQGQDLMASGNTTVKATFGKDSSVVKWVVLAEVLVGAVMYMMTKNVKFLAGFAIISVFIAVGMAVVGLK

SEQ ID NO: 9849 - protein, 170 aa, Escherichia coli DEC13A [sequence omitted]

SEQ ID NO: 9850 - protein, 368 aa, Escherichia coli DEC13A
MNKTITALAIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSATIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 9851 - protein, 241 aa, Escherichia coli DEC13A; identical to SEQ ID NO: 6138

SEQ ID NO: 9852 - protein, 863 aa, Escherichia coli DEC13A
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTDIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCIANYQLPPESQQQLLTQLSAECR

SEQ ID NO: 9853 - protein, 784 aa, Escherichia coli DEC13A; identical to SEQ ID NO: 6283

SEQ ID NO: 9854 - protein, 765 aa, Escherichia coli DEC13A
MQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGSLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEKGNVIGNVGQGGQAFVRGIEQQGNISIKWLEESKPVSCLAHYQQSSEAEKIAQSIILNGIRCQIQ

SEQ ID NO: 9855 - protein, 230 aa, Escherichia coli DEC13A; identical to SEQ ID NO: 7855

SEQ ID NO: 9856 - protein, 747 aa, Escherichia coli DEC13A; identical to SEQ ID NO: 6343

SEQ ID NO: 9857 - protein, 266 aa, Escherichia coli DEC13A; identical to SEQ ID NO: 5772

SEQ ID NO: 9858 - protein, 161 aa, Escherichia coli DEC13A; identical to SEQ ID NO: 5769

SEQ ID NO: 9859 - protein, 351 aa, Escherichia coli DEC13A
MKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGGEDLVNYIDVGATYYFNKNMSAFVDYKINQLDSDNKLNINNDDIVAVGMTYQF

SEQ ID NO: 9860 - protein, 230 aa, Escherichia coli DEC13A; identical to SEQ ID NO: 6294

SEQ ID NO: 9861 - protein, 869 aa, Escherichia coli DEC13A
MKIPTTTDIPQRYTWCLAGICYSSLAILPSFLSYAESYFNPAFLLENGTSVADLSRFERGNHQPARVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDELIIVNYHNLRFSRKDRLQLNISQSLNDFGSLYISGTHQKYWNTSDSDTWYQVGYTNSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 9862 - protein, 746 aa, Escherichia coli DEC13A; identical to SEQ ID NO: 6296

SEQ ID NO: 9863 - protein, 193 aa, Escherichia coli DEC13A; identical to SEQ ID NO: 6300

SEQ ID NO: 9864 - protein, 191 aa, Escherichia coli DEC13A; identical to SEQ ID NO: 6437

SEQ ID NO: 9865 - protein, 213 aa, Escherichia coli DEC13A
MTKMSRYALITALAMFLAGCVGQREPAPVEEVKPAPEQPAEPQQPVPTVPSVPTIPQQPGPIEHEDQTAPPAPHIRHYDWNGAMQPMVSKMLGADGVTAGSVLLVDSVNNRTNGSLNAAEATETLRNALANNGKFTQVSAQQLSMAKQQLGLSPQDSLGTRSKAIGIARNVGAHYVLYSSASGNVNAPTLQMQLMLVQTGEIIWSGKGAVSQQ

SEQ ID NO: 9866 - protein, 207 aa, Escherichia coli DEC13A; identical to SEQ ID NO: 5743

SEQ ID NO: 9867 - protein, 243 aa, Escherichia coli DEC13A; identical to SEQ ID NO: 6463

SEQ ID NO: 9868 - protein, 816 aa, Escherichia coli DEC13A
MNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVIVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 9869 - protein, 430 aa, Escherichia coli DEC13A; identical to SEQ ID NO: 5758

SEQ ID NO: 9870 - protein, 331 aa, Escherichia coli DEC13A; identical to SEQ ID NO: 6456

SEQ ID NO: 9871 - protein, 760 aa, Escherichia coli DEC13A
MENNRNFPARQFNSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLMNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 9872 - protein, 203 aa, Escherichia coli DEC13A; identical to SEQ ID NO: 6414

SEQ ID NO: 9873 - protein, 361 aa, Escherichia coli DEC13A; identical to SEQ ID NO: 7868

SEQ ID NO: 9874 - protein, 224 aa, Escherichia coli DEC13A; identical to SEQ ID NO: 7869

SEQ ID NO: 9875 - protein, 591 aa, Escherichia coli DEC13A
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRINSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKITPG

SEQ ID NO: 9876 - protein, 229 aa, Escherichia coli DEC13A; identical to SEQ ID NO: 9369

SEQ ID NO: 9877 - protein, 232 aa, Escherichia coli DEC13A; identical to SEQ ID NO: 5747

SEQ ID NO: 9878 - protein, 729 aa, Escherichia coli DEC13A
MLSTQFNRDNQYQAITKPSLLAGCIALALLPSAAFAAPATEETVIVEGSATAPEDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 9879 - protein, 203 aa, Escherichia coli DEC13A; identical to SEQ ID NO: 6347

SEQ ID NO: 9880 - protein, 565 aa, Escherichia coli DEC13A
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFAMMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 9881 - protein, 111 aa, Escherichia coli DEC13A; identical to SEQ ID NO: 8676

SEQ ID NO: 9882 - protein, 118 aa, Escherichia coli DEC13A [sequence omitted]

SEQ ID NO: 9883 - protein, 387 aa, Escherichia coli DEC13A
MKRKVLAMLVPALLVAGAANAAEIYNKNGNKLDLYGKVDTRHTFSDNPGDDGDETIIELGFKGETQITDQLTGYGQALTKTKASDTEGSDNTYVKLAFAGLKFGEMGSFDYGRNYGVIYDVEAWTDMLPVFGGDSYTWTDNFMAGRANGVATYRNSDFFGLVEGLNFALQYQGNNEGSNAGEDQEGTKNGHEDVRFQNGDGFGLSTSYDFDFGLSLGAAYSNSDRTNSQVALGGYHYNEYSKFAGGDTAEAWAFGAKYDANNVYLAMMYAETRNMTPYGNVGIANKTQNFEAVAQYQFDFGLRPSLAYVYSKGKDLGGNDYNNNGHQEYVDQDLVNYVEIGATYYFNKNFSTYVDYKINLLDKDDDFYDNNGIATDDVVGVGLVYQF

SEQ ID NO: 9884 - protein, 641 aa, Escherichia coli DEC13A
MLAVDDDGETMVVTASSVEQNLKDAPASISVITQEDLQRKPVQNLKDVLKKVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 9885 - protein, 162 aa, Escherichia coli DEC13A; identical to SEQ ID NO: 6365

SEQ ID NO: 9886 - protein, 367 aa, Escherichia coli DEC13A
MKVKVLSLLVPALLVAGAANAAEVYNKDGNKLDLYGKVDGLHYFSDNDKVDGDKTYMRLGFKGETQVTDQLTGYGQWEYQIQGNAPESENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALEQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGTIGTRNYDDEDILKYVDVGATYYFNKNMSTYVDYKINLLDDNQFTRDAGINTDNIVALGLVYQF

SEQ ID NO: 9887 - protein, 826 aa, Escherichia coli DEC13A; identical to SEQ ID NO: 9108

SEQ ID NO: 9888 - protein, 224 aa, Escherichia coli DEC13A
MKGLLSLLIFSMVLPAHAGIVIYGMRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWYLTIIDDHGNYISDKI

SEQ ID NO: 9889 - protein, 200 aa, Escherichia coli DEC13A; identical to SEQ ID NO: 6311

SEQ ID NO: 9890 - protein, 274 aa, Escherichia coli DEC13A; identical to SEQ ID NO: 9114

SEQ ID NO: 9891 - protein, 250 aa, Escherichia coli DEC13A; identical to SEQ ID NO: 6317

SEQ ID NO: 9892 - protein, 880 aa, Escherichia coli DEC13A
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTQELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 9893 - protein, 518 aa, Escherichia coli DEC13A; identical to SEQ ID NO: 6358

SEQ ID NO: 9894 - protein, 432 aa, Escherichia coli DEC13A; identical to SEQ ID NO: 5727

SEQ ID NO: 9895 - protein, 359 aa, Escherichia coli DEC13A; identical to SEQ ID NO: 6332

SEQ ID NO: 9896 - protein, 686 aa, Escherichia coli DEC13A; identical to SEQ ID NO: 6453

SEQ ID NO: 9897 - protein, 834 aa, Escherichia coli DEC13A; identical to SEQ ID NO: 8715

SEQ ID NO: 9898 - protein, 249 aa, Escherichia coli DEC13A; identical to SEQ ID NO: 6450

SEQ ID NO: 9899 - protein, 231 aa, Escherichia coli DEC13A; identical to SEQ ID NO: 6351

SEQ ID NO: 9900 - protein, 678 aa, Escherichia coli DEC13A
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTADGVASPAQASVSDLTGEQPAAQPAPVSTPAATTTAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 9901 - protein, 386 aa, Escherichia coli DEC13A; identical to SEQ ID NO: 7908

SEQ ID NO: 9902 - protein, 843 aa, Escherichia coli DEC13A; identical to SEQ ID NO: 7909

SEQ ID NO: 9903 - protein, 228 aa, Escherichia coli DEC13A
MKRISFAVLALLMTAQQCFAGGVALSTTRVIYDGGKKEASLTVENHNKNEEFLIQSWIDDVNGNKKTPFIITPPLFKLDPDKNNVLRIVNIEDTLPKDRESVYWINVKAIPAKSAENENKNVLQIAVRTRLKLFYRPKGLPGSNLEAMKQLRFQCQNNQIVVNNDSAYNLTFNQFSINGQKIERAGMVLAKGKLNINLPAGTGNAHEVKYSIINDFGVAGEMLTKPIN

SEQ ID NO: 9904 - protein, 243 aa, Escherichia coli DEC13A; identical to SEQ ID NO: 6145

SEQ ID NO: 9905 - protein, 208 aa, Escherichia coli DEC13A; identical to SEQ ID NO: 5717

SEQ ID NO: 9906 - protein, 614 aa, Escherichia coli DEC13A
MIKKASLLTACSVTAFSAWAQDISPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHFGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 9907 - protein, 446 aa, Escherichia coli DEC13A
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDKYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNGDSKVNPNYGKAVPADFNGGSFGRGDSDEWTFGAQMEIWW

SEQ ID NO: 9908 - protein, 237 aa, Escherichia coli DEC13A; identical to SEQ ID NO: 6313

SEQ ID NO: 9909 - protein, 478 aa, Escherichia coli DEC13A; identical to SEQ ID NO: 8712

SEQ ID NO: 9910 - protein, 784 aa, Escherichia coli DEC13B; identical to SEQ ID NO: 6283

SEQ ID NO: 9911 - protein, 170 aa, Escherichia coli DEC13B [sequence omitted]

SEQ ID NO: 9912 - protein, 765 aa, Escherichia coli DEC13B; identical to SEQ ID NO: 9854

SEQ ID NO: 9913 - protein, 230 aa, Escherichia coli DEC13B; identical to SEQ ID NO: 7855

SEQ ID NO: 9914 - protein, 747 aa, Escherichia coli DEC13B; identical to SEQ ID NO: 6343

SEQ ID NO: 9915 - protein, 266 aa, Escherichia coli DEC13B; identical to SEQ ID NO: 5772

SEQ ID NO: 9916 - protein, 161 aa, Escherichia coli DEC13B; identical to SEQ ID NO: 5769

SEQ ID NO: 9917 - protein, 243 aa, Escherichia coli DEC13B; identical to SEQ ID NO: 6463

SEQ ID NO: 9918 - protein, 816 aa, Escherichia coli DEC13B; identical to SEQ ID NO: 9868

SEQ ID NO: 9919 - protein, 430 aa, Escherichia coli DEC13B; identical to SEQ ID NO: 5758

SEQ ID NO: 9920 - protein, 361 aa, Escherichia coli DEC13B; identical to SEQ ID NO: 7868

SEQ ID NO: 9921 - protein, 233 aa, Escherichia coli DEC13B; identical to SEQ ID NO: 6327

SEQ ID NO: 9922 - protein, 851 aa, Escherichia coli DEC13B
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRINSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 9923 - protein, 229 aa, Escherichia coli DEC13B; identical to SEQ ID NO: 9369

SEQ ID NO: 9924 - protein, 565 aa, Escherichia coli DEC13B; identical to SEQ ID NO: 9880

SEQ ID NO: 9925 - protein, 207 aa, Escherichia coli DEC13B; identical to SEQ ID NO: 5743

SEQ ID NO: 9926 - protein, 230 aa, Escherichia coli DEC13B; identical to SEQ ID NO: 6294

SEQ ID NO: 9927 - protein, 869 aa, Escherichia coli DEC13B
MKIPTTTDIPQRYTWCLAGICYSSLAILPSFLSYAESYFNPAFLLENGTSVADLSRFERGNHQPARVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDELIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 9928 - protein, 746 aa, Escherichia coli DEC13B; identical to SEQ ID NO: 6296

SEQ ID NO: 9929 - protein, 331 aa, Escherichia coli DEC13B; identical to SEQ ID NO: 6456

SEQ ID NO: 9930 - protein, 760 aa, Escherichia coli DEC13B; identical to SEQ ID NO: 9871

SEQ ID NO: 9931 - protein, 191 aa, Escherichia coli DEC13B; identical to SEQ ID NO: 6437

SEQ ID NO: 9932 - protein, 351 aa, Escherichia coli DEC13B; identical to SEQ ID NO: 9859

SEQ ID NO: 9933 - protein, 193 aa, Escherichia coli DEC13B; identical to SEQ ID NO: 6300

SEQ ID NO: 9934 - protein, 203 aa, Escherichia coli DEC13B; identical to SEQ ID NO: 6414

SEQ ID NO: 9935 - protein, 232 aa, Escherichia coli DEC13B; identical to SEQ ID NO: 5747

SEQ ID NO: 9936 - protein, 729 aa, Escherichia coli DEC13B; identical to SEQ ID NO: 9878

SEQ ID NO: 9937 - protein, 213 aa, Escherichia coli DEC13B; identical to SEQ ID NO: 9865

SEQ ID NO: 9938 - protein, 111 aa, Escherichia coli DEC13B; identical to SEQ ID NO: 8676

SEQ ID NO: 9939 - protein, 118 aa, Escherichia coli DEC13B [sequence omitted]

SEQ ID NO: 9940 - protein, 387 aa, Escherichia coli DEC13B; identical to SEQ ID NO: 9883

SEQ ID NO: 9941 - protein, 826 aa, Escherichia coli DEC13B; identical to SEQ ID NO: 9108

SEQ ID NO: 9942 - protein, 213 aa, Escherichia coli DEC13B
MVLPAHAGIVIYGMRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWYLTIIDDHGNYISDKI

SEQ ID NO: 9943 - protein, 631 aa, Escherichia coli DEC13B
MVVTASSVEQNLKDAPASISVITQEDLQRKPVQNLKDVLKKVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 9944 - protein, 162 aa, Escherichia coli DEC13B; identical to SEQ ID NO: 6365

SEQ ID NO: 9945 - protein, 367 aa, Escherichia coli DEC13B; identical to SEQ ID NO: 9886

SEQ ID NO: 9946 - protein, 200 aa, Escherichia coli DEC13B; identical to SEQ ID NO: 6311

SEQ ID NO: 9947 - protein, 274 aa, Escherichia coli DEC13B; identical to SEQ ID NO: 9114

SEQ ID NO: 9948 - protein, 250 aa, Escherichia coli DEC13B; identical to SEQ ID NO: 6317

SEQ ID NO: 9949 - protein, 861 aa, Escherichia coli DEC13B
MSGSYSSVWAEDDIQFDSRFLELKGDTKIDLKRFSSQGYVEPGKYNLQVQLNKQPLAEEYDIYWYAGEDDASKSYACLTQELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 9950 - protein, 518 aa, Escherichia coli DEC13B; identical to SEQ ID NO: 6358

SEQ ID NO: 9951 - protein, 432 aa, Escherichia coli DEC13B; identical to SEQ ID NO: 5727

SEQ ID NO: 9952 - protein, 359 aa, Escherichia coli DEC13B; identical to SEQ ID NO: 6332

SEQ ID NO: 9953 - protein, 523 aa, Escherichia coli DEC13B; identical to SEQ ID NO: 7963

SEQ ID NO: 9954 - protein, 696 aa, Escherichia coli DEC13B; identical to SEQ ID NO: 9053

SEQ ID NO: 9955 - protein, 231 aa, Escherichia coli DEC13B; identical to SEQ ID NO: 8991

SEQ ID NO: 9956 - protein, 231 aa, Escherichia coli DEC13B; identical to SEQ ID NO: 6351

SEQ ID NO: 9957 - protein, 678 aa, Escherichia coli DEC13B; identical to SEQ ID NO: 9900

SEQ ID NO: 9958 - protein, 385 aa, Escherichia coli DEC13B
MDDVPVAQVLQALAEQEKLNLVVSPDVSGTVSLHLTDVPWKQALQTVVKSAGLITRQEDNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 9959 - protein, 840 aa, Escherichia coli DEC13B; identical to SEQ ID NO: 8997

SEQ ID NO: 9960 - protein, 228 aa, Escherichia coli DEC13B; identical to SEQ ID NO: 9903

SEQ ID NO: 9961 - protein, 198 aa, Escherichia coli DEC13B; identical to SEQ ID NO: 8853

SEQ ID NO: 9962 - protein, 208 aa, Escherichia coli DEC13B; identical to SEQ ID NO: 5717

SEQ ID NO: 9963 - protein, 614 aa, Escherichia coli DEC13B; identical to SEQ ID NO: 9906

SEQ ID NO: 9964 - protein, 445 aa, Escherichia coli DEC13B
MITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDKYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNGDSKVNPNYGKAVPADFNGGSFGRGDSDEWTFGAQMEIWW

SEQ ID NO: 9965 - protein, 237 aa, Escherichia coli DEC13B; identical to SEQ ID NO: 6313

SEQ ID NO: 9966 - protein, 478 aa, Escherichia coli DEC13B; identical to SEQ ID NO: 8712

SEQ ID NO: 9967 - protein, 216 aa, Escherichia coli DEC13B; identical to SEQ ID NO: 7978

SEQ ID NO: 9968 - protein, 863 aa, Escherichia coli DEC13B; identical to SEQ ID NO: 9852

SEQ ID NO: 9969 - protein, 121 aa, Escherichia coli DEC13C
MNAVLSVQGASAPVKKKSFFSKFTRLNMLRLVRAVIPVAVLMMLFPELAMASAGKGTDLMAKGNDTVKATFGKDSSIVKWVVLAEVLVGAVMYMMTKNVKFLVGFAIISVFIAVGMTVVGL

SEQ ID NO: 9970 - protein, 784 aa, Escherichia coli DEC13C; identical to SEQ ID NO: 6283

SEQ ID NO: 9971 - protein, 170 aa, Escherichia coli DEC13C [sequence omitted]

SEQ ID NO: 9972 - protein, 230 aa, Escherichia coli DEC13C; identical to SEQ ID NO: 7855

SEQ ID NO: 9973 - protein, 747 aa, Escherichia coli DEC13C; identical to SEQ ID NO: 6343

SEQ ID NO: 9974 - protein, 266 aa, Escherichia coli DEC13C; identical to SEQ ID NO: 5772

SEQ ID NO: 9975 - protein, 161 aa, Escherichia coli DEC13C; identical to SEQ ID NO: 5769

SEQ ID NO: 9976 - protein, 351 aa, Escherichia coli DEC13C; identical to SEQ ID NO: 9859

SEQ ID NO: 9977 - protein, 230 aa, Escherichia coli DEC13C; identical to SEQ ID NO: 6294

SEQ ID NO: 9978 - protein, 780 aa, Escherichia coli DEC13C
MKIPTTTDIPQRYTWCLAGICYSSLAILPSFLSYAESYFNPAFLLENGTSVADLSRFERGNHQPARVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDELIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKISAALCRRKARWFVPILIPA

SEQ ID NO: 9979 - protein, 746 aa, Escherichia coli DEC13C
MNKKIHSLALLVNLGIYGVAQAQEPTDTPVSHDDTIVVTAAEQNLQAPGVSTITADAIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 9980 - protein, 193 aa, Escherichia coli DEC13C; identical to SEQ ID NO: 6300

SEQ ID NO: 9981 - protein, 430 aa, Escherichia coli DEC13C; identical to SEQ ID NO: 5758

SEQ ID NO: 9982 - protein, 360 aa, Escherichia coli DEC13C; identical to SEQ ID NO: 8317

SEQ ID NO: 9983 - protein, 243 aa, Escherichia coli DEC13C; identical to SEQ ID NO: 6463

SEQ ID NO: 9984 - protein, 816 aa, Escherichia coli DEC13C; identical to SEQ ID NO: 9868

SEQ ID NO: 9985 - protein, 331 aa, Escherichia coli DEC13C; identical to SEQ ID NO: 6456

SEQ ID NO: 9986 - protein, 760 aa, Escherichia coli DEC13C
MENNRNFPARQFNSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLKRNGANANGQTDTFAIYAFDTLQITRDFELNGGIRLDNYHTEYDSATACGGSGRGAITCPTGVAKGSPVTTVDTAKSGNLMNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 9987 - protein, 203 aa, Escherichia coli DEC13C; identical to SEQ ID NO: 6414

SEQ ID NO: 9988 - protein, 49 aa, Escherichia coli DEC13C; identical to SEQ ID NO: 9808

SEQ ID NO: 9989 - protein, 224 aa, Escherichia coli DEC13C; identical to SEQ ID NO: 7869

SEQ ID NO: 9990 - protein, 591 aa, Escherichia coli DEC13C; identical to SEQ ID NO: 7870

SEQ ID NO: 9991 - protein, 229 aa, Escherichia coli DEC13C; identical to SEQ ID NO: 9369

SEQ ID NO: 9992 - protein, 191 aa, Escherichia coli DEC13C; identical to SEQ ID NO: 6437

SEQ ID NO: 9993 - protein, 232 aa, Escherichia coli DEC13C; identical to SEQ ID NO: 5747

SEQ ID NO: 9994 - protein, 729 aa, Escherichia coli DEC13C; identical to SEQ ID NO: 9878

SEQ ID NO: 9995 - protein, 213 aa, Escherichia coli DEC13C; identical to SEQ ID NO: 9865

SEQ ID NO: 9996 - protein, 203 aa, Escherichia coli DEC13C; identical to SEQ ID NO: 6347

SEQ ID NO: 9997 - protein, 565 aa, Escherichia coli DEC13C; identical to SEQ ID NO: 9880

SEQ ID NO: 9998 - protein, 207 aa, Escherichia coli DEC13C; identical to SEQ ID NO: 5743

SEQ ID NO: 9999 - protein, 539 aa, Escherichia coli DEC13C; identical to SEQ ID NO: 6525

SEQ ID NO: 10000 - protein, 672 aa, Escherichia coli DEC13C
MIVSAAPQVVSELDTPAAVSVVDGEEMRLATPRINLSESLTGVPGLQVQNRQNYAQDLQLSIRGFGSRSTYGIRGIRLYMDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLHYERSLSAQDDMSVMMYAGERETTQYQSIPMAPQLNPSHAGGVITLQRHYQGVDSRWTHRGELGVPVTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 10001 - protein, 236 aa, Escherichia coli DEC13C; identical to SEQ ID NO: 7814

SEQ ID NO: 10002 - protein, 111 aa, Escherichia coli DEC13C; identical to SEQ ID NO: 8676

SEQ ID NO: 10003 - protein, 118 aa, Escherichia coli DEC13C [sequence omitted]

SEQ ID NO: 10004 - protein, 387 aa, Escherichia coli DEC13C; identical to SEQ ID NO: 9883

SEQ ID NO: 10005 - protein, 826 aa, Escherichia coli DEC13C; identical to SEQ ID NO: 9108

SEQ ID NO: 10006 - protein, 224 aa, Escherichia coli DEC13C; identical to SEQ ID NO: 6435

SEQ ID NO: 10007 - protein, 641 aa, Escherichia coli DEC13C; identical to SEQ ID NO: 9884

SEQ ID NO: 10008 - protein, 162 aa, Escherichia coli DEC13C; identical to SEQ ID NO: 6365

SEQ ID NO: 10009 - protein, 367 aa, Escherichia coli DEC13C; identical to SEQ ID NO: 9886

SEQ ID NO: 10010 - protein, 200 aa, Escherichia coli DEC13C; identical to SEQ ID NO: 6311

SEQ ID NO: 10011 - protein, 274 aa, Escherichia coli DEC13C; identical to SEQ ID NO: 9114

SEQ ID NO: 10012 - protein, 250 aa, Escherichia coli DEC13C; identical to SEQ ID NO: 6317

SEQ ID NO: 10013 - protein, 861 aa, Escherichia coli DEC13C; identical to SEQ ID NO: 9949

SEQ ID NO: 10014 - protein, 472 aa, Escherichia coli DEC13C; identical to SEQ ID NO: 5729

SEQ ID NO: 10015 - protein, 432 aa, Escherichia coli DEC13C; identical to SEQ ID NO: 5727

SEQ ID NO: 10016 - protein, 359 aa, Escherichia coli DEC13C; identical to SEQ ID NO: 6332

SEQ ID NO: 10017 - protein, 615 aa, Escherichia coli DEC13C
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKNVT

SEQ ID NO: 10018 - protein, 834 aa, Escherichia coli DEC13C; identical to SEQ ID NO: 8715

SEQ ID NO: 10019 - protein, 249 aa, Escherichia coli DEC13C; identical to SEQ ID NO: 6450

SEQ ID NO: 10020 - protein, 231 aa, Escherichia coli DEC13C; identical to SEQ ID NO: 6351

SEQ ID NO: 10021 - protein, 806 aa, Escherichia coli DEC13C
MLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSTSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 10022 - protein, 678 aa, Escherichia coli DEC13C; identical to SEQ ID NO: 9900

SEQ ID NO: 10023 - protein, 386 aa, Escherichia coli DEC13C; identical to SEQ ID NO: 7908

SEQ ID NO: 10024 - protein, 843 aa, Escherichia coli DEC13C; identical to SEQ ID NO: 7909

SEQ ID NO: 10025 - protein, 45 aa, Escherichia coli DEC13C
MLTSRPEIRFYATYIKALENELDGFTFEDNKDDQFAVGAQAEIWW

SEQ ID NO: 10026 - protein, 243 aa, Escherichia coli DEC13C; identical to SEQ ID NO: 6145

SEQ ID NO: 10027 - protein, 208 aa, Escherichia coli DEC13C; identical to SEQ ID NO: 5717

SEQ ID NO: 10028 - protein, 614 aa, Escherichia coli DEC13C; identical to SEQ ID NO: 9906

SEQ ID NO: 10029 - protein, 446 aa, Escherichia coli DEC13C; identical to SEQ ID NO: 9907

SEQ ID NO: 10030 - protein, 237 aa, Escherichia coli DEC13C; identical to SEQ ID NO: 6313

SEQ ID NO: 10031 - protein, 478 aa, Escherichia coli DEC13C; identical to SEQ ID NO: 8712

SEQ ID NO: 10032 - protein, 368 aa, Escherichia coli DEC13C; identical to SEQ ID NO: 9850

SEQ ID NO: 10033 - protein, 241 aa, Escherichia coli DEC13C; identical to SEQ ID NO: 6138

SEQ ID NO: 10034 - protein, 856 aa, Escherichia coli DEC13C
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTDIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVELDTNTLADNVDLDNAVANVVPTRGAIVRAEFKARVGIKLLMTLTHNNKPLPFGAMVTSESSQSSGIVADNGQVYLSGMPLAGKVQVKWGEEENAHCIANYQLPPESQQQLLTQLSAECR

SEQ ID NO: 10035 - protein, 765 aa, Escherichia coli DEC13D; identical to SEQ ID NO: 9854

SEQ ID NO: 10036 - protein, 230 aa, Escherichia coli DEC13D; identical to SEQ ID NO: 7855

SEQ ID NO: 10037 - protein, 784 aa, Escherichia coli DEC13D; identical to SEQ ID NO: 6283

SEQ ID NO: 10038 - protein, 170 aa, Escherichia coli DEC13D [sequence omitted]

SEQ ID NO: 10039 - protein, 747 aa, Escherichia coli DEC13D; identical to SEQ ID NO: 6343

SEQ ID NO: 10040 - protein, 266 aa, Escherichia coli DEC13D; identical to SEQ ID NO: 5772

SEQ ID NO: 10041 - protein, 161 aa, Escherichia coli DEC13D; identical to SEQ ID NO: 5769

SEQ ID NO: 10042 - protein, 351 aa, Escherichia coli DEC13D; identical to SEQ ID NO: 9859

SEQ ID NO: 10043 - protein, 230 aa, Escherichia coli DEC13D; identical to SEQ ID NO: 6294

SEQ ID NO: 10044 - protein, 869 aa, Escherichia coli DEC13D; identical to SEQ ID NO: 9927

SEQ ID NO: 10045 - protein, 746 aa, Escherichia coli DEC13D; identical to SEQ ID NO: 6296

SEQ ID NO: 10046 - protein, 193 aa, Escherichia coli DEC13D; identical to SEQ ID NO: 6300

SEQ ID NO: 10047 - protein, 243 aa, Escherichia coli DEC13D; identical to SEQ ID NO: 6463

SEQ ID NO: 10048 - protein, 816 aa, Escherichia coli DEC13D; identical to SEQ ID NO: 9868

SEQ ID NO: 10049 - protein, 430 aa, Escherichia coli DEC13D; identical to SEQ ID NO: 5758

SEQ ID NO: 10050 - protein, 360 aa, Escherichia coli DEC13D; identical to SEQ ID NO: 8317

SEQ ID NO: 10051 - protein, 331 aa, Escherichia coli DEC13D; identical to SEQ ID NO: 6456

SEQ ID NO: 10052 - protein, 760 aa, Escherichia coli DEC13D; identical to SEQ ID NO: 9986

SEQ ID NO: 10053 - protein, 203 aa, Escherichia coli DEC13D; identical to SEQ ID NO: 6414

SEQ ID NO: 10054 - protein, 361 aa, Escherichia coli DEC13D; identical to SEQ ID NO: 7868

SEQ ID NO: 10055 - protein, 224 aa, Escherichia coli DEC13D; identical to SEQ ID NO: 7869

SEQ ID NO: 10056 - protein, 851 aa, Escherichia coli DEC13D
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSSDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 10057 - protein, 229 aa, Escherichia coli DEC13D; identical to SEQ ID NO: 9369

SEQ ID NO: 10058 - protein, 191 aa, Escherichia coli DEC13D; identical to SEQ ID NO: 6437

SEQ ID NO: 10059 - protein, 232 aa, Escherichia coli DEC13D; identical to SEQ ID NO: 5747

SEQ ID NO: 10060 - protein, 729 aa, Escherichia coli DEC13D; identical to SEQ ID NO: 9878

SEQ ID NO: 10061 - protein, 213 aa, Escherichia coli DEC13D; identical to SEQ ID NO: 9865

SEQ ID NO: 10062 - protein, 203 aa, Escherichia coli DEC13D; identical to SEQ ID NO: 6347

SEQ ID NO: 10063 - protein, 565 aa, Escherichia coli DEC13D; identical to SEQ ID NO: 9880

SEQ ID NO: 10064 - protein, 207 aa, Escherichia coli DEC13D; identical to SEQ ID NO: 5743

SEQ ID NO: 10065 - protein, 111 aa, Escherichia coli DEC13D; identical to SEQ ID NO: 8676

SEQ ID NO: 10066 - protein, 387 aa, Escherichia coli DEC13D; identical to SEQ ID NO: 9883

SEQ ID NO: 10067 - protein, 118 aa, Escherichia coli DEC13D [sequence omitted]

SEQ ID NO: 10068 - protein, 826 aa, Escherichia coli DEC13D; identical to SEQ ID NO: 9108

SEQ ID NO: 10069 - protein, 224 aa, Escherichia coli DEC13D; identical to SEQ ID NO: 6435

SEQ ID NO: 10070 - protein, 641 aa, Escherichia coli DEC13D; identical to SEQ ID NO: 9884

SEQ ID NO: 10071 - protein, 162 aa, Escherichia coli DEC13D; identical to SEQ ID NO: 6365

SEQ ID NO: 10072 - protein, 367 aa, Escherichia coli DEC13D; identical to SEQ ID NO: 9886

SEQ ID NO: 10073 - protein, 200 aa, Escherichia coli DEC13D; identical to SEQ ID NO: 6311

SEQ ID NO: 10074 - protein, 274 aa, Escherichia coli DEC13D; identical to SEQ ID NO: 9114

SEQ ID NO: 10075 - protein, 250 aa, Escherichia coli DEC13D; identical to SEQ ID NO: 6317

SEQ ID NO: 10076 - protein, 880 aa, Escherichia coli DEC13D
MPDHSFFRLRILPWCIALAMSGSYSSVWAEDDIQFDSRFLELKGDTKIDLKRFSSQGYVEPGKYNLQVQLNKQPLAEEYDIYWYAGEDDASKSYACLTQELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 10077 - protein, 518 aa, Escherichia coli DEC13D; identical to SEQ ID NO: 6358

SEQ ID NO: 10078 - protein, 359 aa, Escherichia coli DEC13D; identical to SEQ ID NO: 6332

SEQ ID NO: 10079 - protein, 432 aa, Escherichia coli DEC13D; identical to SEQ ID NO: 5727

SEQ ID NO: 10080 - protein, 686 aa, Escherichia coli DEC13D; identical to SEQ ID NO: 6453

SEQ ID NO: 10081 - protein, 834 aa, Escherichia coli DEC13D; identical to SEQ ID NO: 8715

SEQ ID NO: 10082 - protein, 249 aa, Escherichia coli DEC13D; identical to SEQ ID NO: 6450

SEQ ID NO: 10083 - protein, 231 aa, Escherichia coli DEC13D; identical to SEQ ID NO: 6351

SEQ ID NO: 10084 - protein, 838 aa, Escherichia coli DEC13D
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSTSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 10085 - protein, 678 aa, Escherichia coli DEC13D; identical to SEQ ID NO: 9900

SEQ ID NO: 10086 - protein, 258 aa, Escherichia coli DEC13D; identical to SEQ ID NO: 5634

SEQ ID NO: 10087 - protein, 386 aa, Escherichia coli DEC13D; identical to SEQ ID NO: 7908

SEQ ID NO: 10088 - protein, 843 aa, Escherichia coli DEC13D; identical to SEQ ID NO: 7909

SEQ ID NO: 10089 - protein, 228 aa, Escherichia coli DEC13D; identical to SEQ ID NO: 9903

SEQ ID NO: 10090 - protein, 45 aa, Escherichia coli DEC13D; identical to SEQ ID NO: 10025

SEQ ID NO: 10091 - protein, 243 aa, Escherichia coli DEC13D; identical to SEQ ID NO: 6145

SEQ ID NO: 10092 - protein, 208 aa, Escherichia coli DEC13D; identical to SEQ ID NO: 5717

SEQ ID NO: 10093 - protein, 614 aa, Escherichia coli DEC13D; identical to SEQ ID NO: 9906

SEQ ID NO: 10094 - protein, 446 aa, Escherichia coli DEC13D; identical to SEQ ID NO: 9907

SEQ ID NO: 10095 - protein, 237 aa, Escherichia coli DEC13D; identical to SEQ ID NO: 6313

SEQ ID NO: 10096 - protein, 478 aa, Escherichia coli DEC13D; identical to SEQ ID NO: 8712

SEQ ID NO: 10097 - protein, 368 aa, Escherichia coli DEC13D
MNKTITALAIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSATIDKINAHYFDKKAEDYFFNKFLLSFDPSTQQWSYAGESPWYGTTGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 10098 - protein, 241 aa, Escherichia coli DEC13D; identical to SEQ ID NO: 6138

SEQ ID NO: 10099 - protein, 856 aa, Escherichia coli DEC13D
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTDIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCIANYQLPPESQQQLLTQLSAECR

SEQ ID NO: 10100 - protein, 120 aa, Escherichia coli DEC13D
MDAVLSVQGASAPVKKKSFFSKFTRLNMLRLARAVIPAAVLMMFFPQLAMAAQGQDLMASGNTTVKATFGKDSSVVKWVVLAEVLVGAVMYMMTKNVKFLAGFAIISVFIAVGMAVVGLK

SEQ ID NO: 10101 - protein, 784 aa, Escherichia coli DEC13E; identical to SEQ ID NO: 6283

SEQ ID NO: 10102 - protein, 170 aa, Escherichia coli DEC13E [sequence omitted]

SEQ ID NO: 10103 - protein, 765 aa, Escherichia coli DEC13E; identical to SEQ ID NO: 9854

SEQ ID NO: 10104 - protein, 230 aa, Escherichia coli DEC13E; identical to SEQ ID NO: 7855

SEQ ID NO: 10105 - protein, 604 aa, Escherichia coli DEC13E
MQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 10106 - protein, 266 aa, Escherichia coli DEC13E; identical to SEQ ID NO: 5772

SEQ ID NO: 10107 - protein, 161 aa, Escherichia coli DEC13E; identical to SEQ ID NO: 5769

SEQ ID NO: 10108 - protein, 351 aa, Escherichia coli DEC13E; identical to SEQ ID NO: 9859

SEQ ID NO: 10109 - protein, 222 aa, Escherichia coli DEC13E
MLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVSSQIPLPSGVQGKLKFQTVNDYGSVTPVREVNLN

SEQ ID NO: 10110 - protein, 869 aa, Escherichia coli DEC13E; identical to SEQ ID NO: 9927

SEQ ID NO: 10111 - protein, 746 aa, Escherichia coli DEC13E; identical to SEQ ID NO: 6296

SEQ ID NO: 10112 - protein, 193 aa, Escherichia coli DEC13E; identical to SEQ ID NO: 6300

SEQ ID NO: 10113 - protein, 243 aa, Escherichia coli DEC13E; identical to SEQ ID NO: 6463

SEQ ID NO: 10114 - protein, 816 aa, Escherichia coli DEC13E; identical to SEQ ID NO: 9868

SEQ ID NO: 10115 - protein, 430 aa, Escherichia coli DEC13E; identical to SEQ ID NO: 5758

SEQ ID NO: 10116 - protein, 760 aa, Escherichia coli DEC13E; identical to SEQ ID NO: 9986

SEQ ID NO: 10117 - protein, 203 aa, Escherichia coli DEC13E; identical to SEQ ID NO: 6414

SEQ ID NO: 10118 - protein, 361 aa, Escherichia coli DEC13E; identical to SEQ ID NO: 7868

SEQ ID NO: 10119 - protein, 224 aa, Escherichia coli DEC13E; identical to SEQ ID NO: 7869

SEQ ID NO: 10120 - protein, 591 aa, Escherichia coli DEC13E; identical to SEQ ID NO: 7870

SEQ ID NO: 10121 - protein, 360 aa, Escherichia coli DEC13E; identical to SEQ ID NO: 8317

SEQ ID NO: 10122 - protein, 191 aa, Escherichia coli DEC13E; identical to SEQ ID NO: 6437

SEQ ID NO: 10123 - protein, 232 aa, Escherichia coli DEC13E; identical to SEQ ID NO: 5747

SEQ ID NO: 10124 - protein, 226 aa, Escherichia coli DEC13E; identical to SEQ ID NO: 7934

SEQ ID NO: 10125 - protein, 729 aa, Escherichia coli DEC13E; identical to SEQ ID NO: 9878

SEQ ID NO: 10126 - protein, 213 aa, Escherichia coli DEC13E; identical to SEQ ID NO: 9865

SEQ ID NO: 10127 - protein, 203 aa, Escherichia coli DEC13E; identical to SEQ ID NO: 6347

SEQ ID NO: 10128 - protein, 565 aa, Escherichia coli DEC13E; identical to SEQ ID NO: 9880

SEQ ID NO: 10129 - protein, 207 aa, Escherichia coli DEC13E; identical to SEQ ID NO: 5743

SEQ ID NO: 10130 - protein, 539 aa, Escherichia coli DEC13E; identical to SEQ ID NO: 6525

SEQ ID NO: 10131 - protein, 700 aa, Escherichia coli DEC13E
MKIFSVRQTVLPALLALSPVVFAADEQTMIVSAAPQVVSELDTPAAVSVVDGEEMRLATPRINLSESLTGVPGLQVQNRQNYAQDLQLSIRGFGSRSTYGIRGIRLYMDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLHYERSLSAQDDMSVMMYAGERETTQYQSIPMAPQLNPSHAGGVITLQRHYQGVDSRWTHRGELGVPVTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 10132 - protein, 871 aa, Escherichia coli DEC13E
MHQVLILPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLQDRLADASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPSADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 10133 - protein, 236 aa, Escherichia coli DEC13E; identical to SEQ ID NO: 7814

SEQ ID NO: 10134 - protein, 104 aa, Escherichia coli DEC13E
MTMKKVLGLVVAAAMGLSSAAFAAETATTPAPTATTTKAAPAKTTHHKKQHKAAPAQKAQAAKKHHKNTKAEQKAPEQKAQAAKKHAGKHSHQQPAKPAAQPAA

SEQ ID NO: 10135 - protein, 118 aa, Escherichia coli DEC13E [sequence omitted]

SEQ ID NO: 10136 - protein, 382 aa, Escherichia coli DEC13E
MAMLVPALLVAGAANAAEIYNKNGNKLDLYGKVDTRHTFSDNPGDDGDETIIELGFKGETQITDQLTGYGQALTKTKASDTEGSDNTYVKLAFAGLKFGEMGSFDYGRNYGVIYDVEAWTDMLPVFGGDSYTWTDNFMAGRANGVATYRNSDFFGLVEGLNFALQYQGNNEGSNAGEDQEGTKNGHEDVRFQNGDGFGLSTSYDFDFGLSLGAAYSNSDRTNSQVALGGYHYNEYSKFAGGDTAEAWAFGAKYDANNVYLAMMYAETRNMTPYGNVGIANKTQNFEAVAQYQFDFGLRPSLAYVYSKGKDLGGNDYNNNGHQEYVDQDLVNYVEIGATYYFNKNFSTYVDYKINLLDKDDDFYDNNGIATDDVVGVGLVYQF

SEQ ID NO: 10137 - protein, 641 aa, Escherichia coli DEC13E; identical to SEQ ID NO: 9884

SEQ ID NO: 10138 - protein, 367 aa, Escherichia coli DEC13E; identical to SEQ ID NO: 9886

SEQ ID NO: 10139 - protein, 826 aa, Escherichia coli DEC13E; identical to SEQ ID NO: 9108

SEQ ID NO: 10140 - protein, 224 aa, Escherichia coli DEC13E; identical to SEQ ID NO: 6435

SEQ ID NO: 10141 - protein, 162 aa, Escherichia coli DEC13E; identical to SEQ ID NO: 6365

SEQ ID NO: 10142 - protein, 200 aa, Escherichia coli DEC13E; identical to SEQ ID NO: 6311

SEQ ID NO: 10143 - protein, 274 aa, Escherichia coli DEC13E; identical to SEQ ID NO: 9114

SEQ ID NO: 10144 - protein, 250 aa, Escherichia coli DEC13E; identical to SEQ ID NO: 6317

SEQ ID NO: 10145 - protein, 861 aa, Escherichia coli DEC13E; identical to SEQ ID NO: 9949

SEQ ID NO: 10146 - protein, 518 aa, Escherichia coli DEC13E; identical to SEQ ID NO: 6358

SEQ ID NO: 10147 - protein, 432 aa, Escherichia coli DEC13E; identical to SEQ ID NO: 5727

SEQ ID NO: 10148 - protein, 359 aa, Escherichia coli DEC13E; identical to SEQ ID NO: 6332

SEQ ID NO: 10149 - protein, 615 aa, Escherichia coli DEC13E
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKENVT

SEQ ID NO: 10150 - protein, 834 aa, Escherichia coli DEC13E; identical to SEQ ID NO: 8715

SEQ ID NO: 10151 - protein, 249 aa, Escherichia coli DEC13E; identical to SEQ ID NO: 6450

SEQ ID NO: 10152 - protein, 199 aa, Escherichia coli DEC13E; identical to SEQ ID NO: 7966

SEQ ID NO: 10153 - protein, 838 aa, Escherichia coli DEC13E; identical to SEQ ID NO: 10084

SEQ ID NO: 10154 - protein, 678 aa, Escherichia coli DEC13E; identical to SEQ ID NO: 9900

SEQ ID NO: 10155 - protein, 45 aa, Escherichia coli DEC13E; identical to SEQ ID NO: 10025

SEQ ID NO: 10156 - protein, 243 aa, Escherichia coli DEC13E; identical to SEQ ID NO: 6145

SEQ ID NO: 10157 - protein, 386 aa, Escherichia coli DEC13E; identical to SEQ ID NO: 7908

SEQ ID NO: 10158 - protein, 840 aa, Escherichia coli DEC13E
MHLPLYHYRAHFSFSLLALTIASSLPAYGGKFNPKFLENVQGIDQHIDLSVYDSPVDQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYNALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 10159 - protein, 228 aa, Escherichia coli DEC13E; identical to SEQ ID NO: 9903

SEQ ID NO: 10160 - protein, 208 aa, Escherichia coli DEC13E; identical to SEQ ID NO: 5717

SEQ ID NO: 10161 - protein, 614 aa, Escherichia coli DEC13E
MIKKASLLTACSVTAFSAWAQDISPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHAHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHFGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 10162 - protein, 445 aa, Escherichia coli DEC13E; identical to SEQ ID NO: 9964

SEQ ID NO: 10163 - protein, 237 aa, Escherichia coli DEC13E; identical to SEQ ID NO: 6313

SEQ ID NO: 10164 - protein, 478 aa, Escherichia coli DEC13E; identical to SEQ ID NO: 8712

SEQ ID NO: 10165 - protein, 224 aa, Escherichia coli DEC13E
MLAGILMFMAMMVAGRAEAGVALGATRVIYPAGQKQVQLAVTNNDENSTYLIQSWVENADGVKDGRFIVTPPLFAMKGKRENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 10166 - protein, 856 aa, Escherichia coli DEC13E; identical to SEQ ID NO: 10099

SEQ ID NO: 10167 - protein, 784 aa, Escherichia coli DEC14A; identical to SEQ ID NO: 6283

SEQ ID NO: 10168 - protein, 170 aa, Escherichia coli DEC14A [sequence omitted]

SEQ ID NO: 10169 - protein, 765 aa, Escherichia coli DEC14A; identical to SEQ ID NO: 9418

SEQ ID NO: 10170 - protein, 230 aa, Escherichia coli DEC14A; identical to SEQ ID NO: 7855

SEQ ID NO: 10171 - protein, 747 aa, Escherichia coli DEC14A; identical to SEQ ID NO: 6343

SEQ ID NO: 10172 - protein, 266 aa, Escherichia coli DEC14A; identical to SEQ ID NO: 5772

SEQ ID NO: 10173 - protein, 161 aa, Escherichia coli DEC14A; identical to SEQ ID NO: 5769

SEQ ID NO: 10174 - protein, 351 aa, Escherichia coli DEC14A; identical to SEQ ID NO: 6367

SEQ ID NO: 10175 - protein, 230 aa, Escherichia coli DEC14A; identical to SEQ ID NO: 7352

SEQ ID NO: 10176 - protein, 869 aa, Escherichia coli DEC14A
MKIPTTTDIPQRYSWCLAGICYSSLAILPSFLSYAESYFNPAFLLENGTSVADLSRFERGNHQPARVYRVDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDELIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 10177 - protein, 746 aa, Escherichia coli DEC14A; identical to SEQ ID NO: 6296

SEQ ID NO: 10178 - protein, 193 aa, Escherichia coli DEC14A; identical to SEQ ID NO: 6300

SEQ ID NO: 10179 - protein, 243 aa, Escherichia coli DEC14A; identical to SEQ ID NO: 6463

SEQ ID NO: 10180 - protein, 816 aa, Escherichia coli DEC14A; identical to SEQ ID NO: 6462

SEQ ID NO: 10181 - protein, 430 aa, Escherichia coli DEC14A; identical to SEQ ID NO: 5758

SEQ ID NO: 10182 - protein, 331 aa, Escherichia coli DEC14A; identical to SEQ ID NO: 6456

SEQ ID NO: 10183 - protein, 760 aa, Escherichia coli DEC14A; identical to SEQ ID NO: 6455

SEQ ID NO: 10184 - protein, 539 aa, Escherichia coli DEC14A; identical to SEQ ID NO: 6525

SEQ ID NO: 10185 - protein, 700 aa, Escherichia coli DEC14A; identical to SEQ ID NO: 7945

SEQ ID NO: 10186 - protein, 203 aa, Escherichia coli DEC14A; identical to SEQ ID NO: 6414

SEQ ID NO: 10187 - protein, 361 aa, Escherichia coli DEC14A; identical to SEQ ID NO: 7868

SEQ ID NO: 10188 - protein, 224 aa, Escherichia coli DEC14A; identical to SEQ ID NO: 7869

SEQ ID NO: 10189 - protein, 591 aa, Escherichia coli DEC14A
MPSFIGGLVVFVSTAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKITHG

SEQ ID NO: 10190 - protein, 229 aa, Escherichia coli DEC14A; identical to SEQ ID NO: 9369

SEQ ID NO: 10191 - protein, 517 aa, Escherichia coli DEC14A; identical to SEQ ID NO: 6406

SEQ ID NO: 10192 - protein, 191 aa, Escherichia coli DEC14A; identical to SEQ ID NO: 5748

SEQ ID NO: 10193 - protein, 232 aa, Escherichia coli DEC14A; identical to SEQ ID NO: 5747

SEQ ID NO: 10194 - protein, 729 aa, Escherichia coli DEC14A; identical to SEQ ID NO: 6500

SEQ ID NO: 10195 - protein, 213 aa, Escherichia coli DEC14A; identical to SEQ ID NO: 5744

SEQ ID NO: 10196 - protein, 203 aa, Escherichia coli DEC14A; identical to SEQ ID NO: 6396

SEQ ID NO: 10197 - protein, 565 aa, Escherichia coli DEC14A; identical to SEQ ID NO: 6395

SEQ ID NO: 10198 - protein, 207 aa, Escherichia coli DEC14A; identical to SEQ ID NO: 5743

SEQ ID NO: 10199 - protein, 871 aa, Escherichia coli DEC14A
MHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 10200 - protein, 236 aa, Escherichia coli DEC14A; identical to SEQ ID NO: 6472

SEQ ID NO: 10201 - protein, 111 aa, Escherichia coli DEC14A; identical to SEQ ID NO: 5738

SEQ ID NO: 10202 - protein, 130 aa, Escherichia coli DEC14A; identical to SEQ ID NO: 7726

SEQ ID NO: 10203 - protein, 404 aa, Escherichia coli DEC14A
MKRKVLAMLVPALLVAGAANAAEVYNKDGNKLDLYGKVAGLHYFSDDAGSDGDKSYARIGFKGETQIADQFTGYGQWEYNLQANGTEGDGDNSATRLAFAGLGFGQNGTFDYGRNYGVVYDIEAWTDMLPEFGGDTYAGADNFMNGRTNGVATYRNNGFFGQVDGLNFALQYQSNNESGSDGLFGQEGSGSGDGRSLAKENGDGFGMSTSYDFDFGLSLGAAYSNSDRSNNQAARGYGDGNHFYGNSYAGGGTAEAWTVGAKYDANNVYLAAMYAETRNMTAYGSSDSHSADGKLGGGGIANKTQNFEVVAQYQFDFGLRPSIAYLQSKGKDLGGQEMYNNGNYHYTNKDLVKYVEVGATYYFNKNMSTYVDYKINLLDNDDDFYANNGIATDDIVAVGLVYQF

SEQ ID NO: 10204 - protein, 641 aa, Escherichia coli DEC14A
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 10205 - protein, 162 aa, Escherichia coli DEC14A; identical to SEQ ID NO: 5896

SEQ ID NO: 10206 - protein, 367 aa, Escherichia coli DEC14A; identical to SEQ ID NO: 5607

SEQ ID NO: 10207 - protein, 200 aa, Escherichia coli DEC14A; identical to SEQ ID NO: 6311

SEQ ID NO: 10208 - protein, 274 aa, Escherichia coli DEC14A; identical to SEQ ID NO: 8357

SEQ ID NO: 10209 - protein, 250 aa, Escherichia coli DEC14A; identical to SEQ ID NO: 7896

SEQ ID NO: 10210 - protein, 880 aa, Escherichia coli DEC14A
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPITSPAVKPAIQEQTQRVTPTEPPTSISVNQ

SEQ ID NO: 10211 - protein, 826 aa, Escherichia coli DEC14A
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYVSQYYSDYKASGNNKSTYVRFNSGLNLLEWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQTYDENHHEEKRFNIFISIPFDWGDDVTTPRRQIYMSNSTTFDDQGFASNNTGLSGTVGSRDQFNYGVNLSYQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 10212 - protein, 224 aa, Escherichia coli DEC14A; identical to SEQ ID NO: 6435

SEQ ID NO: 10213 - protein, 518 aa, Escherichia coli DEC14A; identical to SEQ ID NO: 6358

SEQ ID NO: 10214 - protein, 432 aa, Escherichia coli DEC14A; identical to SEQ ID NO: 5727

SEQ ID NO: 10215 - protein, 359 aa, Escherichia coli DEC14A; identical to SEQ ID NO: 6332

SEQ ID NO: 10216 - protein, 686 aa, Escherichia coli DEC14A; identical to SEQ ID NO: 6453

SEQ ID NO: 10217 - protein, 834 aa, Escherichia coli DEC14A
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSFSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 10218 - protein, 249 aa, Escherichia coli DEC14A; identical to SEQ ID NO: 6450

SEQ ID NO: 10219 - protein, 231 aa, Escherichia coli DEC14A; identical to SEQ ID NO: 6351

SEQ ID NO: 10220 - protein, 838 aa, Escherichia coli DEC14A; identical to SEQ ID NO: 6447

SEQ ID NO: 10221 - protein, 678 aa, Escherichia coli DEC14A; identical to SEQ ID NO: 7968

SEQ ID NO: 10222 - protein, 386 aa, Escherichia coli DEC14A; identical to SEQ ID NO: 7993

SEQ ID NO: 10223 - protein, 843 aa, Escherichia coli DEC14A; identical to SEQ ID NO: 6288

SEQ ID NO: 10224 - protein, 228 aa, Escherichia coli DEC14A; identical to SEQ ID NO: 6185

SEQ ID NO: 10225 - protein, 614 aa, Escherichia coli DEC14A; identical to SEQ ID NO: 7971

SEQ ID NO: 10226 - protein, 208 aa, Escherichia coli DEC14A; identical to SEQ ID NO: 5717

SEQ ID NO: 10227 - protein, 243 aa, Escherichia coli DEC14A; identical to SEQ ID NO: 6145

SEQ ID NO: 10228 - protein, 446 aa, Escherichia coli DEC14A; identical to SEQ ID NO: 6459

SEQ ID NO: 10229 - protein, 237 aa, Escherichia coli DEC14A; identical to SEQ ID NO: 6384

SEQ ID NO: 10230 - protein, 368 aa, Escherichia coli DEC14A
MNKTITALAIMMASFAANASVLPETPVPFKSGTGAIDNDTVYIGLGSAGTAWYKLDTQAKDKKWTALAAFPGGPRDQATSAFIDGNLYVFGGIGKNNEGLTQVFNDVHKYNPKTNSWVKLMSHAPMGMAGHVTFVHNGKAYVTGGVNQNIFNGYFEDLNQAGKDSTAIDKINTHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGMSNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 10231 - protein, 241 aa, Escherichia coli DEC14A; identical to SEQ ID NO: 6135

SEQ ID NO: 10232 - protein, 856 aa, Escherichia coli DEC14A
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 10233 - protein, 784 aa, Escherichia coli DEC14B; identical to SEQ ID NO: 6283

SEQ ID NO: 10234 - protein, 170 aa, Escherichia coli DEC14B [sequence omitted]

SEQ ID NO: 10235 - protein, 765 aa, Escherichia coli DEC14B; identical to SEQ ID NO: 9075

SEQ ID NO: 10236 - protein, 230 aa, Escherichia coli DEC14B; identical to SEQ ID NO: 7855

SEQ ID NO: 10237 - protein, 747 aa, Escherichia coli DEC14B; identical to SEQ ID NO: 6343

SEQ ID NO: 10238 - protein, 266 aa, Escherichia coli DEC14B; identical to SEQ ID NO: 9078

SEQ ID NO: 10239 - protein, 161 aa, Escherichia coli DEC14B; identical to SEQ ID NO: 5769

SEQ ID NO: 10240 - protein, 351 aa, Escherichia coli DEC14B; identical to SEQ ID NO: 9080

SEQ ID NO: 10241 - protein, 230 aa, Escherichia coli DEC14B; identical to SEQ ID NO: 6294

SEQ ID NO: 10242 - protein, 869 aa, Escherichia coli DEC14B; identical to SEQ ID NO: 9082

SEQ ID NO: 10243 - protein, 746 aa, Escherichia coli DEC14B
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTNF

SEQ ID NO: 10244 - protein, 193 aa, Escherichia coli DEC14B; identical to SEQ ID NO: 6300

SEQ ID NO: 10245 - protein, 243 aa, Escherichia coli DEC14B; identical to SEQ ID NO: 8324

SEQ ID NO: 10246 - protein, 816 aa, Escherichia coli DEC14B; identical to SEQ ID NO: 8325

SEQ ID NO: 10247 - protein, 430 aa, Escherichia coli DEC14B; identical to SEQ ID NO: 5758

SEQ ID NO: 10248 - protein, 331 aa, Escherichia coli DEC14B; identical to SEQ ID NO: 6456

SEQ ID NO: 10249 - protein, 760 aa, Escherichia coli DEC14B; identical to SEQ ID NO: 9087

SEQ ID NO: 10250 - protein, 203 aa, Escherichia coli DEC14B; identical to SEQ ID NO: 6414

SEQ ID NO: 10251 - protein, 361 aa, Escherichia coli DEC14B; identical to SEQ ID NO: 9089

SEQ ID NO: 10252 - protein, 224 aa, Escherichia coli DEC14B; identical to SEQ ID NO: 7869

SEQ ID NO: 10253 - protein, 851 aa, Escherichia coli DEC14B; identical to SEQ ID NO: 8686

SEQ ID NO: 10254 - protein, 130 aa, Escherichia coli DEC14B; identical to SEQ ID NO: 8814

SEQ ID NO: 10255 - protein, 365 aa, Escherichia coli DEC14B; identical to SEQ ID NO: 7354

SEQ ID NO: 10256 - protein, 232 aa, Escherichia coli DEC14B; identical to SEQ ID NO: 5747

SEQ ID NO: 10257 - protein, 729 aa, Escherichia coli DEC14B; identical to SEQ ID NO: 5745

SEQ ID NO: 10258 - protein, 213 aa, Escherichia coli DEC14B; identical to SEQ ID NO: 5744

SEQ ID NO: 10259 - protein, 203 aa, Escherichia coli DEC14B; identical to SEQ ID NO: 6347

SEQ ID NO: 10260 - protein, 565 aa, Escherichia coli DEC14B; identical to SEQ ID NO: 9097

SEQ ID NO: 10261 - protein, 207 aa, Escherichia coli DEC14B; identical to SEQ ID NO: 5743

SEQ ID NO: 10262 - protein, 539 aa, Escherichia coli DEC14B; identical to SEQ ID NO: 9099

SEQ ID NO: 10263 - protein, 672 aa, Escherichia coli DEC14B
MIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 10264 - protein, 113 aa, Escherichia coli DEC14B; identical to SEQ ID NO: 8081

SEQ ID NO: 10265 - protein, 871 aa, Escherichia coli DEC14B
MHQVLILPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLQDRLADASTEFDVGQQHLSLSVPQIYVGRMARGYVSPELWEEGINAGLLNYSFNGDSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSANRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 10266 - protein, 111 aa, Escherichia coli DEC14B; identical to SEQ ID NO: 7885

SEQ ID NO: 10267 - protein, 118 aa, Escherichia coli DEC14B [sequence omitted]

SEQ ID NO: 10268 - protein, 120 aa, Escherichia coli DEC14B
MYAETRNMTPYGNVGIANKTQNFEAVAQYQFDFGLRPSLAYVYSKGKDLGGNDYNNNGHQEYVDQDLVNYVEIGATYYFNKNFSTYVDYKINLLDKDDDFYDNNGIATDDVVGVGLVYQF

SEQ ID NO: 10269 - protein, 826 aa, Escherichia coli DEC14B; identical to SEQ ID NO: 9108

SEQ ID NO: 10270 - protein, 224 aa, Escherichia coli DEC14B; identical to SEQ ID NO: 6435

SEQ ID NO: 10271 - protein, 650 aa, Escherichia coli DEC14B
MSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNAVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 10272 - protein, 274 aa, Escherichia coli DEC14B; identical to SEQ ID NO: 9114

SEQ ID NO: 10273 - protein, 250 aa, Escherichia coli DEC14B; identical to SEQ ID NO: 6317

SEQ ID NO: 10274 - protein, 880 aa, Escherichia coli DEC14B; identical to SEQ ID NO: 6482

SEQ ID NO: 10275 - protein, 518 aa, Escherichia coli DEC14B; identical to SEQ ID NO: 6358

SEQ ID NO: 10276 - protein, 162 aa, Escherichia coli DEC14B; identical to SEQ ID NO: 6365

SEQ ID NO: 10277 - protein, 367 aa, Escherichia coli DEC14B; identical to SEQ ID NO: 5796

SEQ ID NO: 10278 - protein, 200 aa, Escherichia coli DEC14B; identical to SEQ ID NO: 6311

SEQ ID NO: 10279 - protein, 432 aa, Escherichia coli DEC14B; identical to SEQ ID NO: 5727

SEQ ID NO: 10280 - protein, 359 aa, Escherichia coli DEC14B; identical to SEQ ID NO: 6332

SEQ ID NO: 10281 - protein, 120 aa, Escherichia coli DEC14B; identical to SEQ ID NO: 9137

SEQ ID NO: 10282 - protein, 686 aa, Escherichia coli DEC14B; identical to SEQ ID NO: 6453

SEQ ID NO: 10283 - protein, 834 aa, Escherichia coli DEC14B; identical to SEQ ID NO: 8715

SEQ ID NO: 10284 - protein, 249 aa, Escherichia coli DEC14B; identical to SEQ ID NO: 6450

SEQ ID NO: 10285 - protein, 231 aa, Escherichia coli DEC14B; identical to SEQ ID NO: 6351

SEQ ID NO: 10286 - protein, 838 aa, Escherichia coli DEC14B; identical to SEQ ID NO: 7363

SEQ ID NO: 10287 - protein, 678 aa, Escherichia coli DEC14B; identical to SEQ ID NO: 6353

SEQ ID NO: 10288 - protein, 386 aa, Escherichia coli DEC14B; identical to SEQ ID NO: 7908

SEQ ID NO: 10289 - protein, 843 aa, Escherichia coli DEC14B; identical to SEQ ID NO: 7909

SEQ ID NO: 10290 - protein, 228 aa, Escherichia coli DEC14B; identical to SEQ ID NO: 9903

SEQ ID NO: 10291 - protein, 408 aa, Escherichia coli DEC14B; identical to SEQ ID NO: 9130

SEQ ID NO: 10292 - protein, 243 aa, Escherichia coli DEC14B; identical to SEQ ID NO: 6145

SEQ ID NO: 10293 - protein, 208 aa, Escherichia coli DEC14B; identical to SEQ ID NO: 5717

SEQ ID NO: 10294 - protein, 614 aa, Escherichia coli DEC14B; identical to SEQ ID NO: 6387

SEQ ID NO: 10295 - protein, 446 aa, Escherichia coli DEC14B; identical to SEQ ID NO: 6459

SEQ ID NO: 10296 - protein, 237 aa, Escherichia coli DEC14B; identical to SEQ ID NO: 6313

SEQ ID NO: 10297 - protein, 368 aa, Escherichia coli DEC14B; identical to SEQ ID NO: 9134

SEQ ID NO: 10298 - protein, 216 aa, Escherichia coli DEC14B; identical to SEQ ID NO: 8786

SEQ ID NO: 10299 - protein, 863 aa, Escherichia coli DEC14B
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMLQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCIANYQLPPESQQQLLTQLSAECR

SEQ ID NO: 10300 - protein, 170 aa, Escherichia coli DEC14C [sequence omitted]

SEQ ID NO: 10301 - protein, 765 aa, Escherichia coli DEC14C; identical to SEQ ID NO: 9075

SEQ ID NO: 10302 - protein, 230 aa, Escherichia coli DEC14C; identical to SEQ ID NO: 7855

SEQ ID NO: 10303 - protein, 784 aa, Escherichia coli DEC14C; identical to SEQ ID NO: 6283

SEQ ID NO: 10304 - protein, 662 aa, Escherichia coli DEC14C
MTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 10305 - protein, 266 aa, Escherichia coli DEC14C; identical to SEQ ID NO: 9078

SEQ ID NO: 10306 - protein, 161 aa, Escherichia coli DEC14C; identical to SEQ ID NO: 5769

SEQ ID NO: 10307 - protein, 351 aa, Escherichia coli DEC14C; identical to SEQ ID NO: 9080

SEQ ID NO: 10308 - protein, 222 aa, Escherichia coli DEC14C; identical to SEQ ID NO: 10109

SEQ ID NO: 10309 - protein, 780 aa, Escherichia coli DEC14C
MKIPTTTDIPQRYTWCLAGICYSSLAILPSFLSYAESYFNPAFLLENGTSVADLSRFERGNHQPARVYRVDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDELIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKILAALCRRKARWFVPILIPA

SEQ ID NO: 10310 - protein, 365 aa, Escherichia coli DEC14C; identical to SEQ ID NO: 7354

SEQ ID NO: 10311 - protein, 746 aa, Escherichia coli DEC14C; identical to SEQ ID NO: 10243

SEQ ID NO: 10312 - protein, 193 aa, Escherichia coli DEC14C; identical to SEQ ID NO: 6300

SEQ ID NO: 10313 - protein, 162 aa, Escherichia coli DEC14C
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKTATMPFCKSPFRVVSRCSGDRLHYARKQEKRSNCSYRSASRATN

SEQ ID NO: 10314 - protein, 816 aa, Escherichia coli DEC14C; identical to SEQ ID NO: 8325

SEQ ID NO: 10315 - protein, 430 aa, Escherichia coli DEC14C; identical to SEQ ID NO: 5758

SEQ ID NO: 10316 - protein, 331 aa, Escherichia coli DEC14C; identical to SEQ ID NO: 6456

SEQ ID NO: 10317 - protein, 760 aa, Escherichia coli DEC14C
MENNRNFPARQFNSLTFFAGLCIGITPVAQALAAEGQTNTDDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 10318 - protein, 203 aa, Escherichia coli DEC14C; identical to SEQ ID NO: 6414

SEQ ID NO: 10319 - protein, 191 aa, Escherichia coli DEC14C; identical to SEQ ID NO: 5748

SEQ ID NO: 10320 - protein, 232 aa, Escherichia coli DEC14C; identical to SEQ ID NO: 5747

SEQ ID NO: 10321 - protein, 361 aa, Escherichia coli DEC14C; identical to SEQ ID NO: 9089

SEQ ID NO: 10322 - protein, 224 aa, Escherichia coli DEC14C; identical to SEQ ID NO: 7869

SEQ ID NO: 10323 - protein, 851 aa, Escherichia coli DEC14C
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRINYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 10324 - protein, 140 aa, Escherichia coli DEC14C
MRLLRTESDILPVDRETLFELSIASVPSGKVENQSVKVAMRSVFKLFWRPEGLPGDPLEAYQQLRWTRNSQGVQLTNPTPYYINLIQLSVNGKALSNAGVVPPKSQRQTSWCQAIAPCHVAWRAINDYGGLSAKKEQNLP

SEQ ID NO: 10325 - protein, 729 aa, Escherichia coli DEC14C; identical to SEQ ID NO: 5745

SEQ ID NO: 10326 - protein, 213 aa, Escherichia coli DEC14C; identical to SEQ ID NO: 5744

SEQ ID NO: 10327 - protein, 203 aa, Escherichia coli DEC14C; identical to SEQ ID NO: 6347

SEQ ID NO: 10328 - protein, 565 aa, Escherichia coli DEC14C; identical to SEQ ID NO: 9097

SEQ ID NO: 10329 - protein, 207 aa, Escherichia coli DEC14C; identical to SEQ ID NO: 5743

SEQ ID NO: 10330 - protein, 539 aa, Escherichia coli DEC14C; identical to SEQ ID NO: 6525

SEQ ID NO: 10331 - protein, 700 aa, Escherichia coli DEC14C; identical to SEQ ID NO: 7945

SEQ ID NO: 10332 - protein, 871 aa, Escherichia coli DEC14C; identical to SEQ ID NO: 10265

SEQ ID NO: 10333 - protein, 236 aa, Escherichia coli DEC14C; identical to SEQ ID NO: 9104

SEQ ID NO: 10334 - protein, 111 aa, Escherichia coli DEC14C; identical to SEQ ID NO: 7885

SEQ ID NO: 10335 - protein, 123 aa, Escherichia coli DEC14C
MLWRKHEKRGAFLGLLLVSACASVFAANNETSKSVTFPKCEGLDAAGIAASVKRDYQQNRVARWADDQKIVGQADPVAWVSLQDIQGKDDKWSVPLTVRGKSADIHYQVSVDCKAGMAEYQRR

SEQ ID NO: 10336 - protein, 387 aa, Escherichia coli DEC14C; identical to SEQ ID NO: 9107

SEQ ID NO: 10337 - protein, 826 aa, Escherichia coli DEC14C; identical to SEQ ID NO: 9108

SEQ ID NO: 10338 - protein, 224 aa, Escherichia coli DEC14C; identical to SEQ ID NO: 6435

SEQ ID NO: 10339 - protein, 641 aa, Escherichia coli DEC14C; identical to SEQ ID NO: 7954

SEQ ID NO: 10340 - protein, 162 aa, Escherichia coli DEC14C; identical to SEQ ID NO: 6365

SEQ ID NO: 10341 - protein, 367 aa, Escherichia coli DEC14C; identical to SEQ ID NO: 5796

SEQ ID NO: 10342 - protein, 192 aa, Escherichia coli DEC14C; identical to SEQ ID NO: 7894

SEQ ID NO: 10343 - protein, 274 aa, Escherichia coli DEC14C; identical to SEQ ID NO: 9114

SEQ ID NO: 10344 - protein, 250 aa, Escherichia coli DEC14C; identical to SEQ ID NO: 6317

SEQ ID NO: 10345 - protein, 861 aa, Escherichia coli DEC14C; identical to SEQ ID NO: 9768

SEQ ID NO: 10346 - protein, 518 aa, Escherichia coli DEC14C; identical to SEQ ID NO: 6358

SEQ ID NO: 10347 - protein, 432 aa, Escherichia coli DEC14C; identical to SEQ ID NO: 5727

SEQ ID NO: 10348 - protein, 359 aa, Escherichia coli DEC14C; identical to SEQ ID NO: 6332

SEQ ID NO: 10349 - protein, 231 aa, Escherichia coli DEC14C; identical to SEQ ID NO: 6351

SEQ ID NO: 10350 - protein, 721 aa, Escherichia coli DEC14C; identical to SEQ ID NO: 9124

SEQ ID NO: 10351 - protein, 678 aa, Escherichia coli DEC14C; identical to SEQ ID NO: 6353

SEQ ID NO: 10352 - protein, 615 aa, Escherichia coli DEC14C; identical to SEQ ID NO: 10149

SEQ ID NO: 10353 - protein, 822 aa, Escherichia coli DEC14C; identical to SEQ ID NO: 7370

SEQ ID NO: 10354 - protein, 249 aa, Escherichia coli DEC14C; identical to SEQ ID NO: 6450

SEQ ID NO: 10355 - protein, 840 aa, Escherichia coli DEC14C; identical to SEQ ID NO: 8997

SEQ ID NO: 10356 - protein, 228 aa, Escherichia coli DEC14C; identical to SEQ ID NO: 9903

SEQ ID NO: 10357 - protein, 386 aa, Escherichia coli DEC14C; identical to SEQ ID NO: 7908

SEQ ID NO: 10358 - protein, 198 aa, Escherichia coli DEC14C; identical to SEQ ID NO: 8853

SEQ ID NO: 10359 - protein, 208 aa, Escherichia coli DEC14C; identical to SEQ ID NO: 5717

SEQ ID NO: 10360 - protein, 614 aa, Escherichia coli DEC14C; identical to SEQ ID NO: 6387

SEQ ID NO: 10361 - protein, 446 aa, Escherichia coli DEC14C; identical to SEQ ID NO: 6459

SEQ ID NO: 10362 - protein, 237 aa, Escherichia coli DEC14C; identical to SEQ ID NO: 6313

SEQ ID NO: 10363 - protein, 478 aa, Escherichia coli DEC14C; identical to SEQ ID NO: 5711

SEQ ID NO: 10364 - protein, 241 aa, Escherichia coli DEC14C; identical to SEQ ID NO: 6143

SEQ ID NO: 10365 - protein, 863 aa, Escherichia coli DEC14C; identical to SEQ ID NO: 10299

SEQ ID NO: 10366 - protein, 170 aa, Escherichia coli DEC14D [sequence omitted]

SEQ ID NO: 10367 - protein, 747 aa, Escherichia coli DEC14D; identical to SEQ ID NO: 6343

SEQ ID NO: 10368 - protein, 266 aa, Escherichia coli DEC14D; identical to SEQ ID NO: 9078

SEQ ID NO: 10369 - protein, 161 aa, Escherichia coli DEC14D; identical to SEQ ID NO: 5769

SEQ ID NO: 10370 - protein, 351 aa, Escherichia coli DEC14D; identical to SEQ ID NO: 9080

SEQ ID NO: 10371 - protein, 230 aa, Escherichia coli DEC14D; identical to SEQ ID NO: 6294

SEQ ID NO: 10372 - protein, 869 aa, Escherichia coli DEC14D; identical to SEQ ID NO: 9082

SEQ ID NO: 10373 - protein, 746 aa, Escherichia coli DEC14D; identical to SEQ ID NO: 10243

SEQ ID NO: 10374 - protein, 193 aa, Escherichia coli DEC14D; identical to SEQ ID NO: 6300

SEQ ID NO: 10375 - protein, 243 aa, Escherichia coli DEC14D; identical to SEQ ID NO: 8324

SEQ ID NO: 10376 - protein, 816 aa, Escherichia coli DEC14D; identical to SEQ ID NO: 8325

SEQ ID NO: 10377 - protein, 430 aa, Escherichia coli DEC14D; identical to SEQ ID NO: 5758

SEQ ID NO: 10378 - protein, 331 aa, Escherichia coli DEC14D; identical to SEQ ID NO: 6456

SEQ ID NO: 10379 - protein, 760 aa, Escherichia coli DEC14D; identical to SEQ ID NO: 9087

SEQ ID NO: 10380 - protein, 365 aa, Escherichia coli DEC14D; identical to SEQ ID NO: 7354

SEQ ID NO: 10381 - protein, 120 aa, Escherichia coli DEC14D; identical to SEQ ID NO: 9137

SEQ ID NO: 10382 - protein, 216 aa, Escherichia coli DEC14D
MKSKLIILLMLVPFSSFSTENNFEINKTRVIYSDSTPSVQISNNKAYPLIVQSNIWDENNNKNHDFIATPPIFKMESESRNIIKIIKTNIKLPDSQESMRWLCIESMPPTEKSTKINRKEGRTDSINISIRGCIKLIYRPASVPSPVFNNIVEKLKWHKNGKYLVLKNNTPYYISFSEVFFDSDKVNNAKDILYVKPYSEKKIDISNRIIKKSNGQ

SEQ ID NO: 10383 - protein, 203 aa, Escherichia coli DEC14D; identical to SEQ ID NO: 6414

SEQ ID NO: 10384 - protein, 361 aa, Escherichia coli DEC14D; identical to SEQ ID NO: 9089

SEQ ID NO: 10385 - protein, 224 aa, Escherichia coli DEC14D; identical to SEQ ID NO: 7869

SEQ ID NO: 10386 - protein, 653 aa, Escherichia coli DEC14D
MRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLSRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 10387 - protein, 226 aa, Escherichia coli DEC14D; identical to SEQ ID NO: 7934

SEQ ID NO: 10388 - protein, 191 aa, Escherichia coli DEC14D; identical to SEQ ID NO: 5748

SEQ ID NO: 10389 - protein, 232 aa, Escherichia coli DEC14D; identical to SEQ ID NO: 5747

SEQ ID NO: 10390 - protein, 729 aa, Escherichia coli DEC14D; identical to SEQ ID NO: 5745

SEQ ID NO: 10391 - protein, 213 aa, Escherichia coli DEC14D; identical to SEQ ID NO: 5744

SEQ ID NO: 10392 - protein, 203 aa, Escherichia coli DEC14D; identical to SEQ ID NO: 6347

SEQ ID NO: 10393 - protein, 565 aa, Escherichia coli DEC14D; identical to SEQ ID NO: 9097

SEQ ID NO: 10394 - protein, 207 aa, Escherichia coli DEC14D; identical to SEQ ID NO: 5743

SEQ ID NO: 10395 - protein, 539 aa, Escherichia coli DEC14D; identical to SEQ ID NO: 6525

SEQ ID NO: 10396 - protein, 700 aa, Escherichia coli DEC14D; identical to SEQ ID NO: 7945

SEQ ID NO: 10397 - protein, 871 aa, Escherichia coli DEC14D
MHQVLILPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLQDRLADASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSANRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 10398 - protein, 236 aa, Escherichia coli DEC14D; identical to SEQ ID NO: 9104

SEQ ID NO: 10399 - protein, 111 aa, Escherichia coli DEC14D; identical to SEQ ID NO: 7885

SEQ ID NO: 10400 - protein, 118 aa, Escherichia coli DEC14D [sequence omitted]

SEQ ID NO: 10401 - protein, 387 aa, Escherichia coli DEC14D; identical to SEQ ID NO: 9883

SEQ ID NO: 10402 - protein, 826 aa, Escherichia coli DEC14D; identical to SEQ ID NO: 9108

SEQ ID NO: 10403 - protein, 224 aa, Escherichia coli DEC14D; identical to SEQ ID NO: 6435

SEQ ID NO: 10404 - protein, 641 aa, Escherichia coli DEC14D; identical to SEQ ID NO: 7954

SEQ ID NO: 10405 - protein, 162 aa, Escherichia coli DEC14D; identical to SEQ ID NO: 6365

SEQ ID NO: 10406 - protein, 367 aa, Escherichia coli DEC14D; identical to SEQ ID NO: 5796

SEQ ID NO: 10407 - protein, 200 aa, Escherichia coli DEC14D; identical to SEQ ID NO: 6311

SEQ ID NO: 10408 - protein, 274 aa, Escherichia coli DEC14D; identical to SEQ ID NO: 9114

SEQ ID NO: 10409 - protein, 250 aa, Escherichia coli DEC14D; identical to SEQ ID NO: 6317

SEQ ID NO: 10410 - protein, 880 aa, Escherichia coli DEC14D; identical to SEQ ID NO: 6482

SEQ ID NO: 10411 - protein, 518 aa, Escherichia coli DEC14D; identical to SEQ ID NO: 6358

SEQ ID NO: 10412 - protein, 432 aa, Escherichia coli DEC14D; identical to SEQ ID NO: 5727

SEQ ID NO: 10413 - protein, 359 aa, Escherichia coli DEC14D; identical to SEQ ID NO: 6332

SEQ ID NO: 10414 - protein, 686 aa, Escherichia coli DEC14D; identical to SEQ ID NO: 6453

SEQ ID NO: 10415 - protein, 834 aa, Escherichia coli DEC14D; identical to SEQ ID NO: 8715

SEQ ID NO: 10416 - protein, 125 aa, Escherichia coli DEC14D; identical to SEQ ID NO: 7904

SEQ ID NO: 10417 - protein, 231 aa, Escherichia coli DEC14D; identical to SEQ ID NO: 6351

SEQ ID NO: 10418 - protein, 838 aa, Escherichia coli DEC14D
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQEDQQCQFAFSTPDSEPTTSVLQGTAQCH

SEQ ID NO: 10419 - protein, 678 aa, Escherichia coli DEC14D
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPAPVSTPAATTTAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQIQGFEINGNTGSLTANPDCVINRKLSWLQYQQGQVVPAS

SEQ ID NO: 10420 - protein, 386 aa, Escherichia coli DEC14D; identical to SEQ ID NO: 7908

SEQ ID NO: 10421 - protein, 843 aa, Escherichia coli DEC14D; identical to SEQ ID NO: 7909

SEQ ID NO: 10422 - protein, 162 aa, Escherichia coli DEC14D
MSGSAFAVTHHAFSSGAGRTSDGNGSHASTLKSPSYTKSVSWQHYPKSAENENKNVLQIAVRTRLKLFYRPKGLPGSNLEAMKQLRFQCQNNQIVVNNDSAYNLTFNQFSINGQKIERAGMVLAKGKLNINLPAGTGNAHEVKYSIINDFGVAGEMLTKPIN

SEQ ID NO: 10423 - protein, 115 aa, Escherichia coli DEC14D
MKRISFAVLALLMTAQQCFAGGVALSTTRVIYDGGKKEASLTVENHNKNEEFLIQSWIDDVNGNKKTPFIITPPLFKLDPDKNNVLRIVNIEDTLPKDRESVYWINVKAIPAKSG

SEQ ID NO: 10424 - protein, 243 aa, Escherichia coli DEC14D; identical to SEQ ID NO: 6145

SEQ ID NO: 10425 - protein, 208 aa, Escherichia coli DEC14D; identical to SEQ ID NO: 5717

SEQ ID NO: 10426 - protein, 614 aa, Escherichia coli DEC14D; identical to SEQ ID NO: 6387

SEQ ID NO: 10427 - protein, 446 aa, Escherichia coli DEC14D; identical to SEQ ID NO: 6459

SEQ ID NO: 10428 - protein, 237 aa, Escherichia coli DEC14D; identical to SEQ ID NO: 6313

SEQ ID NO: 10429 - protein, 478 aa, Escherichia coli DEC14D; identical to SEQ ID NO: 5711

SEQ ID NO: 10430 - protein, 784 aa, Escherichia coli DEC14D; identical to SEQ ID NO: 6283

SEQ ID NO: 10431 - protein, 368 aa, Escherichia coli DEC14D; identical to SEQ ID NO: 9134

SEQ ID NO: 10432 - protein, 216 aa, Escherichia coli DEC14D; identical to SEQ ID NO: 8786

SEQ ID NO: 10433 - protein, 863 aa, Escherichia coli DEC14D; identical to SEQ ID NO: 10299

SEQ ID NO: 10434 - protein, 765 aa, Escherichia coli DEC15A; identical to SEQ ID NO: 8790

SEQ ID NO: 10435 - protein, 230 aa, Escherichia coli DEC15A; identical to SEQ ID NO: 7855

SEQ ID NO: 10436 - protein, 784 aa, Escherichia coli DEC15A; identical to SEQ ID NO: 6283

SEQ ID NO: 10437 - protein, 170 aa, Escherichia coli DEC15A [sequence omitted]

SEQ ID NO: 10438 - protein, 747 aa, Escherichia coli DEC15A
MARSKTAQPKHSLRKIAVVVATAVSGMSVYAQAAVEPKEDTITATAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 10439 - protein, 266 aa, Escherichia coli DEC15A; identical to SEQ ID NO: 5772

SEQ ID NO: 10440 - protein, 161 aa, Escherichia coli DEC15A; identical to SEQ ID NO: 5769

SEQ ID NO: 10441 - protein, 351 aa, Escherichia coli DEC15A; identical to SEQ ID NO: 5767

SEQ ID NO: 10442 - protein, 193 aa, Escherichia coli DEC15A; identical to SEQ ID NO: 6300

SEQ ID NO: 10443 - protein, 230 aa, Escherichia coli DEC15A; identical to SEQ ID NO: 7352

SEQ ID NO: 10444 - protein, 869 aa, Escherichia coli DEC15A
MKIPTTTDIPQRYSWCLAGICYSSLAILPSFLSYAESYFNPAFLLENGTSVADLSRFERGNHQPARVYRVDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDELIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYTSFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 10445 - protein, 746 aa, Escherichia coli DEC15A
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFHLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 10446 - protein, 331 aa, Escherichia coli DEC15A; identical to SEQ ID NO: 6456

SEQ ID NO: 10447 - protein, 243 aa, Escherichia coli DEC15A; identical to SEQ ID NO: 6463

SEQ ID NO: 10448 - protein, 816 aa, Escherichia coli DEC15A; identical to SEQ ID NO: 6462

SEQ ID NO: 10449 - protein, 430 aa, Escherichia coli DEC15A; identical to SEQ ID NO: 5758

SEQ ID NO: 10450 - protein, 760 aa, Escherichia coli DEC15A; identical to SEQ ID NO: 6455

SEQ ID NO: 10451 - protein, 203 aa, Escherichia coli DEC15A; identical to SEQ ID NO: 6414

SEQ ID NO: 10452 - protein, 361 aa, Escherichia coli DEC15A; identical to SEQ ID NO: 7868

SEQ ID NO: 10453 - protein, 224 aa, Escherichia coli DEC15A; identical to SEQ ID NO: 7869

SEQ ID NO: 10454 - protein, 591 aa, Escherichia coli DEC15A; identical to SEQ ID NO: 9368

SEQ ID NO: 10455 - protein, 130 aa, Escherichia coli DEC15A
MPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQVIAQCHVAWRAINDYGGLSAKKEQNLP

SEQ ID NO: 10456 - protein, 250 aa, Escherichia coli DEC15A
MKIRTALLVSSLPLCFFVSANAKTFENEGNKTQMFSLHLGATRVIYNIFSSGETLTIINDHDYPMLVQSEVLLEDQKTPAPFIITPPLFRLDALQSSRLRIVRTGGDFPKDRETLQWICVKGIPPKSDEKWAESNKNSLNNVTLNVQVSLSTCIKMFVRPSSVKGHPEDVAGEVKWQRVNNKLKGVNPTPFYINLSELRVGGKEISEHHYIAPFSSFEYPIPVSKSSKVQWKIVTDYGGVSEFFETDINL

SEQ ID NO: 10457 - protein, 849 aa, Escherichia coli DEC15A
MLHINSMVKVCFFVIIAFSLFHTRNSDGKTYSFDASLLKRRGEGVDLTLFENGGQLPGIYPVDIFLNGTIVGSEDIFFHAEHSNGKPYLKACLSEELLMRYGVKTEKYPKLFLSHYGKKDERQCADLSVIPQATEEFLFEAQKLVLSIPQVAIRSPLRGVASDLIWEDGISTFLLNWQVEAGHSEFQHYEKTTSDNFWASLEPGINIGPWRIRNLTTLNKSSGQVGKWESSYIRAERGLNNIKSRLTLGEDYTPADIFASVPFRGVMLGTDENMIPYNQRGFAPVIRGIARTQARIEIRQNGYLIQSQTVAAGPFALTDLPITGSGGEFQVTIFESDGAIQSFNVPFTTPAIALREGYLKYNISAGQYRSSDESVEKAYLWQATAMYGLPRALTVFGGVQTAEHYQAAALGVGLSLGNMGAASLDTIYSRGQQKGYDFDTGNSWRIRYDKSFKLTDTSFSAASYQYSNEGYHELSDILDTYRSGANFVFNDTDRKRRRITININQSLGPWGFIGLSGGRDEYKGGDRQDYIGASYSMSWKDISFSVNWTRNRNVGDYFSNRTFNEDTVGMWMSIPLKHWLGKNDNDVNATAQIQHSTRQNTRYEMGLNGRAFDQKLYWDIREQIVPGSKYDADTSRLNMRWSGSYGELVGMYSYNSHTRQMNAGMSGSIAMHSEGITFGQRFGDTMALIAAPGVRGASVGGWPGVSTDSRGYALVSYITPYQENIITLDPTTFPENAEVLQTDTRVVPTKGAVVRAKFKTRVGNRAVVRLARADGTPLPFGTVVTLEGKTEVSNSTGVVDDKGMVYLSGLSEAGKLKAQWGMNSHCYANYRLPVKKGPAGLYLTSAVCI

SEQ ID NO: 10458 - protein, 669 aa, Escherichia coli DEC15A
MIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANVIGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 10459 - protein, 517 aa, Escherichia coli DEC15A; identical to SEQ ID NO: 6406

SEQ ID NO: 10460 - protein, 191 aa, Escherichia coli DEC15A; identical to SEQ ID NO: 5748

SEQ ID NO: 10461 - protein, 232 aa, Escherichia coli DEC15A; identical to SEQ ID NO: 5747

SEQ ID NO: 10462 - protein, 729 aa, Escherichia coli DEC15A; identical to SEQ ID NO: 5745

SEQ ID NO: 10463 - protein, 213 aa, Escherichia coli DEC15A
MTKMSRYALITALAMFLAGCVGQREPAPVEEVKPAPEQPAEPQQPVPTVPSVPTIPQQPGPIEHEDQTAPPAPHIRHYDWNGAMQPMVSKMLGADGVTAGSVLLVDSVNNRTNGSLNAAEATETLRNALANNEKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 10464 - protein, 121 aa, Escherichia coli DEC15A
MNTVLSVQGASAPVEKKSFFSKFTRLNMLRLARAVIPAAVLMMFFPQLAMAAQGAGQDLMQSGNSTVKATFGKDSSVVKWVVLAEVLVGAVMYMMTKNVKFLAGFAIISVFIAVGMAVVGL

SEQ ID NO: 10465 - protein, 497 aa, Escherichia coli DEC15A
MTVKISGVLKDGTGKPVQNCTIVLKARRTSSTVVVNTVASENPDEAGRYSMDVEHGQYSVTLLVEGFPPSHAGTITVYEDSRPGTLNDFLGAMTEDDARPEALRRFELMVEEVVRNAEEAKKNAGEAETSARNAGISASQAEESAANADTSAGDASESARQAAESAASAKQSEEASSSSASAAAQKASESLQSATDAELSKKTAESAAGNAARDATTATEKARESAESAQSAEQSRIAAEEAVNRIPTVVGPPGPKGEPGPAGPQGPKGDKGERGDTGPAGATGERGPAGDAGPAGPQGPKGDRGETGLTGNAGPQGPKGDAGAAGPAGPQGPKGDTGAAGPAGPQGPKGDAGAAGPAGPQGPKGDTGAAGPTGPQGPKGDTGAAGPAGPQGPKGDAGVAGPAGPQGPSGSPDSGLFGVGSFVLAAYYQTYYSGDRAPGSTVAGSSLSACCLSNGTPLVASGNVGETRLPGTWRACGPMLWTSSPGIRQAGLFQRIS

SEQ ID NO: 10466 - protein, 203 aa, Escherichia coli DEC15A; identical to SEQ ID NO: 6347

SEQ ID NO: 10467 - protein, 565 aa, Escherichia coli DEC15A; identical to SEQ ID NO: 6395

SEQ ID NO: 10468 - protein, 207 aa, Escherichia coli DEC15A; identical to SEQ ID NO: 5743

SEQ ID NO: 10469 - protein, 539 aa, Escherichia coli DEC15A; identical to SEQ ID NO: 6525

SEQ ID NO: 10470 - protein, 700 aa, Escherichia coli DEC15A; identical to SEQ ID NO: 7945

SEQ ID NO: 10471 - protein, 224 aa, Escherichia coli DEC15A
MATMLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDITHAATGDISFQTINDYGALTPRIKATMQ

SEQ ID NO: 10472 - protein, 111 aa, Escherichia coli DEC15A; identical to SEQ ID NO: 7885

SEQ ID NO: 10473 - protein, 130 aa, Escherichia coli DEC15A; identical to SEQ ID NO: 7726

SEQ ID NO: 10474 - protein, 395 aa, Escherichia coli DEC15A
MKRKVLAMLVPALLVAGAANAAEVYNKDGNKLDLYGKVAGLHYFSDDASSDGDMSYARIGFKGETQIADQFTGYGQWEFNIGANGPESDKGNTATRLAFAGFGFGQNGTFDYGRNYSVVYDVEAWTDMLPEFGGDTYAGADNFMNGRANSVATYRNNGFFGQVDGLNFALQYQGNNEKSGLFDQEGSGNGNGRKLAKENGDGYGMSTSYDFDFGLSLGAAYSNSDRTDNQVHKGTHNTRYGDRFDATAGGETAEAWTVGAKYDANNVYLAAMYAETRNMTGYGDADAIANKTQNFEVVAQYQFDFGLRPSIAYLQSKGKDLGGLNGDNFDSQGNHHYANKDLVKYVEVGATYYFNKNMSTYVDYKINLLDNDDDFYKENGIATDDIVAVGLVYQF

SEQ ID NO: 10475 - protein, 673 aa, Escherichia coli DEC15A; identical to SEQ ID NO: 6170

SEQ ID NO: 10476 - protein, 360 aa, Escherichia coli DEC15A; identical to SEQ ID NO: 8317

SEQ ID NO: 10477 - protein, 162 aa, Escherichia coli DEC15A; identical to SEQ ID NO: 5896

SEQ ID NO: 10478 - protein, 367 aa, Escherichia coli DEC15A; identical to SEQ ID NO: 5784

SEQ ID NO: 10479 - protein, 200 aa, Escherichia coli DEC15A; identical to SEQ ID NO: 6311

SEQ ID NO: 10480 - protein, 274 aa, Escherichia coli DEC15A; identical to SEQ ID NO: 6549

SEQ ID NO: 10481 - protein, 250 aa, Escherichia coli DEC15A
MSDLLCSAKLGATTLALLLSAASLSAQASVTPDRTRLIFNESDKSISVTLRNNDPKLPYLAQSWIEDEKGNKISSPLTVLPPVQRIDSMMNGQVKVQGMPDINKLPADRESLFYFNVREIPPKTNKANTLQIALQTRIKLFWRPKALENVSMKNPWQYKVTLTRNGQEFTVNNPTPYYVIFSNASTQKNGNPAAGFSPIVMSPKTSAPLNVKMGSVPVLTYVNDYGARMPLFFTCNGNSCQVDEEQSRKG

SEQ ID NO: 10482 - protein, 459 aa, Escherichia coli DEC15A
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFLVLKLPGGSLTAGRYMAAHWEMKTISLRRLASVAICLHSARSRLMLLTRTPNWIKTPLMAKVRWTVTPSV

SEQ ID NO: 10483 - protein, 826 aa, Escherichia coli DEC15A
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTNQRKPWFIKALRADGQPLMFGYEVNDIHGHNIGVVGQGSQLFIRTNEVPPSVNVAIDKQQGLSCTITFGKEIDESRNYICQ

SEQ ID NO: 10484 - protein, 224 aa, Escherichia coli DEC15A; identical to SEQ ID NO: 6435

SEQ ID NO: 10485 - protein, 641 aa, Escherichia coli DEC15A
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFACTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 10486 - protein, 518 aa, Escherichia coli DEC15A; identical to SEQ ID NO: 6358

SEQ ID NO: 10487 - protein, 432 aa, Escherichia coli DEC15A; identical to SEQ ID NO: 5727

SEQ ID NO: 10488 - protein, 359 aa, Escherichia coli DEC15A
MKKYLALALIAPLLISCSTTKKGDTYNEAWVKDTNGFDILMGQFAHNIENIWGFKEVVIAGPKDYVKYTDQYQTRSHINFDDGTITIETIAGAEPAAHLRRAIIKTLLMGDDPSSVDLYSDVDDITISKEPFLYGQVVDNTGQPIRWEGRASNFADYLLKNRLQSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 10489 - protein, 686 aa, Escherichia coli DEC15A; identical to SEQ ID NO: 6453

SEQ ID NO: 10490 - protein, 834 aa, Escherichia coli DEC15A; identical to SEQ ID NO: 8715

SEQ ID NO: 10491 - protein, 249 aa, Escherichia coli DEC15A; identical to SEQ ID NO: 6450

SEQ ID NO: 10492 - protein, 231 aa, Escherichia coli DEC15A
MSKRTFAVIITLLCSFCIGQALAGGIVLQRTRVIYDASRKETALPVANKGAETPYLLQSWVDNIDGTSRAPFIITPPLFRLEAGDDSSLRIIKTADNLPENKESLFYINVRAIPAKKKSDDVNANELTLVFKTRIKMFYRPAHLKGRVNDAWTSLEFKRSDHSLNIYNPTEYYVVFAGLAVDKTDLTSKIEYIAPGEHKQLPLPASGGKNVKWAAINDYGGSSGTETRPLQ

SEQ ID NO: 10493 - protein, 838 aa, Escherichia coli DEC15A
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDENNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSRISSKSQSWTVRWGNQADQQCQFAFSTPDSEPTTSVLQGTAQCH

SEQ ID NO: 10494 - protein, 678 aa, Escherichia coli DEC15A; identical to SEQ ID NO: 7968

SEQ ID NO: 10495 - protein, 386 aa, Escherichia coli DEC15A; identical to SEQ ID NO: 7993

SEQ ID NO: 10496 - protein, 211 aa, Escherichia coli DEC15A
MKKIWLALAGLVLAFSASAAQYEDGKQYTTLEKPVAGAPQVLEFFSFFCPHCYQFEEVLHISDNVKKKLPEGVKMTKYHVNFMGGDLGKDLTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSNMDVFVQQYADTVKYLSEKNNSM

SEQ ID NO: 10497 - protein, 243 aa, Escherichia coli DEC15A; identical to SEQ ID NO: 6145

SEQ ID NO: 10498 - protein, 732 aa, Escherichia coli DEC15A
MMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYENFLFNAGLLMHITERQQAWFNFSQGVALPDPGKYYGRGIYGAAVNGHLPLTKSVNVSDSKLEGVKVDSYELGWRFIGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSSGYGPASLYDYKGRGRTFGLNYSVLF

SEQ ID NO: 10499 - protein, 614 aa, Escherichia coli DEC15A; identical to SEQ ID NO: 6387

SEQ ID NO: 10500 - protein, 446 aa, Escherichia coli DEC15A; identical to SEQ ID NO: 6459

SEQ ID NO: 10501 - protein, 237 aa, Escherichia coli DEC15A; identical to SEQ ID NO: 6533

SEQ ID NO: 10502 - protein, 478 aa, Escherichia coli DEC15A; identical to SEQ ID NO: 5711

SEQ ID NO: 10503 - protein, 368 aa, Escherichia coli DEC15A; identical to SEQ ID NO: 7849

SEQ ID NO: 10504 - protein, 241 aa, Escherichia coli DEC15A; identical to SEQ ID NO: 6134

SEQ ID NO: 10505 - protein, 837 aa, Escherichia coli DEC15A
MSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 10506 - protein, 747 aa, Escherichia coli DEC15B; identical to SEQ ID NO: 6343

SEQ ID NO: 10507 - protein, 266 aa, Escherichia coli DEC15B; identical to SEQ ID NO: 5772

SEQ ID NO: 10508 - protein, 161 aa, Escherichia coli DEC15B; identical to SEQ ID NO: 5769

SEQ ID NO: 10509 - protein, 351 aa, Escherichia coli DEC15B; identical to SEQ ID NO: 5767

SEQ ID NO: 10510 - protein, 222 aa, Escherichia coli DEC15B
MLIIFYLIISASTHAAGGIALGATRIIYPADAQQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 10511 - protein, 869 aa, Escherichia coli DEC15B; identical to SEQ ID NO: 10444

SEQ ID NO: 10512 - protein, 746 aa, Escherichia coli DEC15B; identical to SEQ ID NO: 10445

SEQ ID NO: 10513 - protein, 193 aa, Escherichia coli DEC15B; identical to SEQ ID NO: 6300

SEQ ID NO: 10514 - protein, 243 aa, Escherichia coli DEC15B; identical to SEQ ID NO: 6463

SEQ ID NO: 10515 - protein, 816 aa, Escherichia coli DEC15B; identical to SEQ ID NO: 6462

SEQ ID NO: 10516 - protein, 430 aa, Escherichia coli DEC15B; identical to SEQ ID NO: 5758

SEQ ID NO: 10517 - protein, 331 aa, Escherichia coli DEC15B; identical to SEQ ID NO: 6456

SEQ ID NO: 10518 - protein, 760 aa, Escherichia coli DEC15B; identical to SEQ ID NO: 6455

SEQ ID NO: 10519 - protein, 203 aa, Escherichia coli DEC15B; identical to SEQ ID NO: 6414

SEQ ID NO: 10520 - protein, 361 aa, Escherichia coli DEC15B; identical to SEQ ID NO: 7868

SEQ ID NO: 10521 - protein, 224 aa, Escherichia coli DEC15B; identical to SEQ ID NO: 7869

SEQ ID NO: 10522 - protein, 591 aa, Escherichia coli DEC15B; identical to SEQ ID NO: 9368

SEQ ID NO: 10523 - protein, 229 aa, Escherichia coli DEC15B
MALLIFAVLSLLVAGELQAGVVVGGTRFIFPADKESIAILLTNTSQESWLINSKINRPTRWAGGEVSTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQVIAQCHVAWRAINDYGGLSAKKEQNLP

SEQ ID NO: 10524 - protein, 453 aa, Escherichia coli DEC15B
MVVNTVASENPDEAGRYSMDVEHGQYSVTLLVEGFPPSHAGTITVYEDSRPGTLNDFLGAMTEDDARPEALRRFELMVEEVVRNAEEAKKNAGEAETSARNAGISASQAEESAANADTSAGDASESARQAAESAASAKQSEEASSSSASAAAQKASESLQSATDAELSKKTAESAAGNAARDATTATEKARESAESAQSAEQSRIAAEEAVNRIPTVVGPPGPKGEPGPAGPQGPKGDKGERGDTGPAGATGERGPAGDAGPAGPQGPKGDRGETGLTGAAGPAGPQGPKGDTGAAGPAGPQGPKGDTGAAGPAGPQGPKGDAGVAGPAGPQGPKGDTGAAGPAGPQGPKGDAGVAGPAGPQGPSGSPDSGLFGVGSFVLAAYYQTYYSGDRAPGSTVAGSSLSACCLSNGTPLVASGNVGETRLPGTWRACGPMLWTSSPGIRQAGLFQRIS

SEQ ID NO: 10525 - protein, 849 aa, Escherichia coli DEC15B; identical to SEQ ID NO: 10457

SEQ ID NO: 10526 - protein, 696 aa, Escherichia coli DEC15B
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANVIGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 10527 - protein, 517 aa, Escherichia coli DEC15B; identical to SEQ ID NO: 6406

SEQ ID NO: 10528 - protein, 191 aa, Escherichia coli DEC15B; identical to SEQ ID NO: 5748

SEQ ID NO: 10529 - protein, 232 aa, Escherichia coli DEC15B; identical to SEQ ID NO: 5747

SEQ ID NO: 10530 - protein, 729 aa, Escherichia coli DEC15B; identical to SEQ ID NO: 5745

SEQ ID NO: 10531 - protein, 213 aa, Escherichia coli DEC15B; identical to SEQ ID NO: 10463

SEQ ID NO: 10532 - protein, 203 aa, Escherichia coli DEC15B; identical to SEQ ID NO: 6347

SEQ ID NO: 10533 - protein, 565 aa, Escherichia coli DEC15B; identical to SEQ ID NO: 6395

SEQ ID NO: 10534 - protein, 207 aa, Escherichia coli DEC15B; identical to SEQ ID NO: 5743

SEQ ID NO: 10535 - protein, 539 aa, Escherichia coli DEC15B; identical to SEQ ID NO: 6525

SEQ ID NO: 10536 - protein, 700 aa, Escherichia coli DEC15B; identical to SEQ ID NO: 7945

SEQ ID NO: 10537 - protein, 224 aa, Escherichia coli DEC15B; identical to SEQ ID NO: 10471

SEQ ID NO: 10538 - protein, 111 aa, Escherichia coli DEC15B; identical to SEQ ID NO: 7885

SEQ ID NO: 10539 - protein, 118 aa, Escherichia coli DEC15B [sequence omitted]

SEQ ID NO: 10540 - protein, 360 aa, Escherichia coli DEC15B; identical to SEQ ID NO: 8317

SEQ ID NO: 10541 - protein, 395 aa, Escherichia coli DEC15B; identical to SEQ ID NO: 10474

SEQ ID NO: 10542 - protein, 673 aa, Escherichia coli DEC15B; identical to SEQ ID NO: 6170

SEQ ID NO: 10543 - protein, 274 aa, Escherichia coli DEC15B; identical to SEQ ID NO: 6549

SEQ ID NO: 10544 - protein, 250 aa, Escherichia coli DEC15B; identical to SEQ ID NO: 10481

SEQ ID NO: 10545 - protein, 880 aa, Escherichia coli DEC15B
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 10546 - protein, 518 aa, Escherichia coli DEC15B; identical to SEQ ID NO: 6358

SEQ ID NO: 10547 - protein, 432 aa, Escherichia coli DEC15B; identical to SEQ ID NO: 5727

SEQ ID NO: 10548 - protein, 823 aa, Escherichia coli DEC15B
MTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTNQRKPWFIKALRADGQPLMFGYEVNDIHGHNIGVVGQGSQLFIRTNEVPPSVNVAIDKQQGLSCTITFGKEIDESRNYICQ

SEQ ID NO: 10549 - protein, 224 aa, Escherichia coli DEC15B; identical to SEQ ID NO: 6435

SEQ ID NO: 10550 - protein, 641 aa, Escherichia coli DEC15B; identical to SEQ ID NO: 7667

SEQ ID NO: 10551 - protein, 162 aa, Escherichia coli DEC15B; identical to SEQ ID NO: 5896

SEQ ID NO: 10552 - protein, 367 aa, Escherichia coli DEC15B; identical to SEQ ID NO: 5784

SEQ ID NO: 10553 - protein, 192 aa, Escherichia coli DEC15B; identical to SEQ ID NO: 7894

SEQ ID NO: 10554 - protein, 121 aa, Escherichia coli DEC15B; identical to SEQ ID NO: 10464

SEQ ID NO: 10555 - protein, 359 aa, Escherichia coli DEC15B; identical to SEQ ID NO: 10488

SEQ ID NO: 10556 - protein, 686 aa, Escherichia coli DEC15B; identical to SEQ ID NO: 6453

SEQ ID NO: 10557 - protein, 834 aa, Escherichia coli DEC15B; identical to SEQ ID NO: 8715

SEQ ID NO: 10558 - protein, 249 aa, Escherichia coli DEC15B; identical to SEQ ID NO: 6450

SEQ ID NO: 10559 - protein, 199 aa, Escherichia coli DEC15B; identical to SEQ ID NO: 7966

SEQ ID NO: 10560 - protein, 823 aa, Escherichia coli DEC15B
MALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDENNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSRISSKSQSWTVRWGNQADQQCQFAFSTPDSEPTTSVLQGTAQCH

SEQ ID NO: 10561 - protein, 678 aa, Escherichia coli DEC15B; identical to SEQ ID NO: 7968

SEQ ID NO: 10562 - protein, 386 aa, Escherichia coli DEC15B; identical to SEQ ID NO: 7993

SEQ ID NO: 10563 - protein, 732 aa, Escherichia coli DEC15B; identical to SEQ ID NO: 10498

SEQ ID NO: 10564 - protein, 243 aa, Escherichia coli DEC15B; identical to SEQ ID NO: 6145

SEQ ID NO: 10565 - protein, 208 aa, Escherichia coli DEC15B; identical to SEQ ID NO: 5717

SEQ ID NO: 10566 - protein, 614 aa, Escherichia coli DEC15B; identical to SEQ ID NO: 6387

SEQ ID NO: 10567 - protein, 368 aa, Escherichia coli DEC15B; identical to SEQ ID NO: 7849

SEQ ID NO: 10568 - protein, 241 aa, Escherichia coli DEC15B; identical to SEQ ID NO: 6134

SEQ ID NO: 10569 - protein, 863 aa, Escherichia coli DEC15B
MHIRKHRLAGFFVRLVVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 10570 - protein, 784 aa, Escherichia coli DEC15B; identical to SEQ ID NO: 6283

SEQ ID NO: 10571 - protein, 170 aa, Escherichia coli DEC15B [sequence omitted]

SEQ ID NO: 10572 - protein, 765 aa, Escherichia coli DEC15B; identical to SEQ ID NO: 8790

SEQ ID NO: 10573 - protein, 246 aa, Escherichia coli DEC15B; identical to SEQ ID NO: 6342

SEQ ID NO: 10574 - protein, 446 aa, Escherichia coli DEC15B; identical to SEQ ID NO: 6459

SEQ ID NO: 10575 - protein, 237 aa, Escherichia coli DEC15B; identical to SEQ ID NO: 6533

SEQ ID NO: 10576 - protein, 478 aa, Escherichia coli DEC15B; identical to SEQ ID NO: 5711

SEQ ID NO: 10577 - protein, 721 aa, Escherichia coli DEC15C
MSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 10578 - protein, 266 aa, Escherichia coli DEC15C; identical to SEQ ID NO: 5772

SEQ ID NO: 10579 - protein, 161 aa, Escherichia coli DEC15C; identical to SEQ ID NO: 5769

SEQ ID NO: 10580 - protein, 351 aa, Escherichia coli DEC15C; identical to SEQ ID NO: 5767

SEQ ID NO: 10581 - protein, 222 aa, Escherichia coli DEC15C; identical to SEQ ID NO: 10510

SEQ ID NO: 10582 - protein, 869 aa, Escherichia coli DEC15C; identical to SEQ ID NO: 10444

SEQ ID NO: 10583 - protein, 746 aa, Escherichia coli DEC15C; identical to SEQ ID NO: 10445

SEQ ID NO: 10584 - protein, 193 aa, Escherichia coli DEC15C; identical to SEQ ID NO: 6300

SEQ ID NO: 10585 - protein, 243 aa, Escherichia coli DEC15C; identical to SEQ ID NO: 6463

SEQ ID NO: 10586 - protein, 816 aa, Escherichia coli DEC15C; identical to SEQ ID NO: 6462

SEQ ID NO: 10587 - protein, 430 aa, Escherichia coli DEC15C; identical to SEQ ID NO: 5758

SEQ ID NO: 10588 - protein, 331 aa, Escherichia coli DEC15C; identical to SEQ ID NO: 6456

SEQ ID NO: 10589 - protein, 760 aa, Escherichia coli DEC15C; identical to SEQ ID NO: 6455

SEQ ID NO: 10590 - protein, 203 aa, Escherichia coli DEC15C; identical to SEQ ID NO: 6414

SEQ ID NO: 10591 - protein, 361 aa, Escherichia coli DEC15C; identical to SEQ ID NO: 7868

SEQ ID NO: 10592 - protein, 224 aa, Escherichia coli DEC15C; identical to SEQ ID NO: 7869

SEQ ID NO: 10593 - protein, 866 aa, Escherichia coli DEC15C; identical to SEQ ID NO: 8332

SEQ ID NO: 10594 - protein, 128 aa, Escherichia coli DEC15C
MDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQVIAQCHVAWRAINDYGGLSAKKEQNLP

SEQ ID NO: 10595 - protein, 423 aa, Escherichia coli DEC15C
MVVNTVASENPDEAGRYSMDVEHGQYSVTLLVEGFPPSHAGTITVYEDSRPGTLNDFLGAMTEDDARPEALRRFELMVEEVVRNAEEAKKNAGEAETSARNAGISASQAEESAANADTSAGDASESARQAAESAASAKQSEEASSSSASAAAQKASESLQSATDAELSKKTAESAAGNAARDATTATEKARESAESAQSAEQSRIAAEEAVNRIPTVVGPPGPKGEPGPAGPQGPKGDKGERGDTGPAGATGERGPAGDAGPAGPQGPKGDRGETGLTGAAGPAGPQGPKGDTGAAGPAGPQGPKGDTGAAGPAGPQGPKGDAGVAGPAGPQGPSGSPDSGLFGVGSFVLAAYYQTYYSGDRAPGSTVAGSSLSACCLSNGTPLVASGNVGETRLPGTWRACGPMLWTSSPGIRQAGLFQRIS

SEQ ID NO: 10596 - protein, 696 aa, Escherichia coli DEC15C; identical to SEQ ID NO: 10526

SEQ ID NO: 10597 - protein, 517 aa, Escherichia coli DEC15C; identical to SEQ ID NO: 6406

SEQ ID NO: 10598 - protein, 191 aa, Escherichia coli DEC15C; identical to SEQ ID NO: 5748

SEQ ID NO: 10599 - protein, 232 aa, Escherichia coli DEC15C; identical to SEQ ID NO: 5747

SEQ ID NO: 10600 - protein, 729 aa, Escherichia coli DEC15C; identical to SEQ ID NO: 5745

SEQ ID NO: 10601 - protein, 213 aa, Escherichia coli DEC15C; identical to SEQ ID NO: 10463

SEQ ID NO: 10602 - protein, 203 aa, Escherichia coli DEC15C; identical to SEQ ID NO: 6347

SEQ ID NO: 10603 - protein, 565 aa, Escherichia coli DEC15C; identical to SEQ ID NO: 6395

SEQ ID NO: 10604 - protein, 207 aa, Escherichia coli DEC15C; identical to SEQ ID NO: 5743

SEQ ID NO: 10605 - protein, 539 aa, Escherichia coli DEC15C; identical to SEQ ID NO: 6525

SEQ ID NO: 10606 - protein, 690 aa, Escherichia coli DEC15C
MPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 10607 - protein, 883 aa, Escherichia coli DEC15C
MTAIRAAFKAYRMHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSATNGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 10608 - protein, 224 aa, Escherichia coli DEC15C; identical to SEQ ID NO: 10471

SEQ ID NO: 10609 - protein, 104 aa, Escherichia coli DEC15C
MTMKKVLALVVAAAMGLSSAAFAAETATTPAPTATTTKAAPAKTTHHKKQHKAAPAQKAQAAKKHHKNTKAEQKAPEQKAQAAKKHAGKHSHQQPAKPAAQPAA

SEQ ID NO: 10610 - protein, 118 aa, Escherichia coli DEC15C [sequence omitted]

SEQ ID NO: 10611 - protein, 518 aa, Escherichia coli DEC15C; identical to SEQ ID NO: 6358

SEQ ID NO: 10612 - protein, 360 aa, Escherichia coli DEC15C; identical to SEQ ID NO: 8317

SEQ ID NO: 10613 - protein, 395 aa, Escherichia coli DEC15C; identical to SEQ ID NO: 10474

SEQ ID NO: 10614 - protein, 671 aa, Escherichia coli DEC15C
MTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 10615 - protein, 826 aa, Escherichia coli DEC15C; identical to SEQ ID NO: 10483

SEQ ID NO: 10616 - protein, 224 aa, Escherichia coli DEC15C; identical to SEQ ID NO: 6435

SEQ ID NO: 10617 - protein, 641 aa, Escherichia coli DEC15C; identical to SEQ ID NO: 7667

SEQ ID NO: 10618 - protein, 367 aa, Escherichia coli DEC15C; identical to SEQ ID NO: 5784

SEQ ID NO: 10619 - protein, 200 aa, Escherichia coli DEC15C; identical to SEQ ID NO: 6311

SEQ ID NO: 10620 - protein, 274 aa, Escherichia coli DEC15C; identical to SEQ ID NO: 6549

SEQ ID NO: 10621 - protein, 250 aa, Escherichia coli DEC15C; identical to SEQ ID NO: 10481

SEQ ID NO: 10622 - protein, 880 aa, Escherichia coli DEC15C; identical to SEQ ID NO: 10545

SEQ ID NO: 10623 - protein, 121 aa, Escherichia coli DEC15C; identical to SEQ ID NO: 10464

SEQ ID NO: 10624 - protein, 432 aa, Escherichia coli DEC15C; identical to SEQ ID NO: 5727

SEQ ID NO: 10625 - protein, 359 aa, Escherichia coli DEC15C; identical to SEQ ID NO: 10488

SEQ ID NO: 10626 - protein, 686 aa, Escherichia coli DEC15C; identical to SEQ ID NO: 6453

SEQ ID NO: 10627 - protein, 834 aa, Escherichia coli DEC15C; identical to SEQ ID NO: 8715

SEQ ID NO: 10628 - protein, 249 aa, Escherichia coli DEC15C; identical to SEQ ID NO: 6450

SEQ ID NO: 10629 - protein, 219 aa, Escherichia coli DEC15C
MCSFCIGQALAGGIVLQRTRVIYDASRKEAALPVANKGAETPYLLQSWVDNIDGTSRAPFIITPPLFRLEAGDDSSLRIIKTADNLPENKESLFYINVRAIPAKKKSDDVNANELTLVFKTRIKMFYRPAHLKGRVNDAWTSLEFKRSDHSLNIYNPTEYYVVFAGLAVDKTDLTSKIEYIAPGEHKQLPLPASGGKNVKWAAINDYGGSSGTETRPLQ

SEQ ID NO: 10630 - protein, 838 aa, Escherichia coli DEC15C; identical to SEQ ID NO: 10493

SEQ ID NO: 10631 - protein, 678 aa, Escherichia coli DEC15C; identical to SEQ ID NO: 7968

SEQ ID NO: 10632 - protein, 386 aa, Escherichia coli DEC15C; identical to SEQ ID NO: 7993

SEQ ID NO: 10633 - protein, 699 aa, Escherichia coli DEC15C
MSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYENFLFNAGLLMHITERQQAWFNFSQGVALPDPGKYYGRGIYGAAVNGHLPLTKSVNVSDSKLEGVKVDSYELGWRFIGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSSGYGPASLYDYKGRGRTFGLNYSVLF

SEQ ID NO: 10634 - protein, 198 aa, Escherichia coli DEC15C; identical to SEQ ID NO: 8853

SEQ ID NO: 10635 - protein, 208 aa, Escherichia coli DEC15C; identical to SEQ ID NO: 5717

SEQ ID NO: 10636 - protein, 614 aa, Escherichia coli DEC15C; identical to SEQ ID NO: 6387

SEQ ID NO: 10637 - protein, 445 aa, Escherichia coli DEC15C; identical to SEQ ID NO: 9001

SEQ ID NO: 10638 - protein, 237 aa, Escherichia coli DEC15C; identical to SEQ ID NO: 6533

SEQ ID NO: 10639 - protein, 368 aa, Escherichia coli DEC15C; identical to SEQ ID NO: 7849

SEQ ID NO: 10640 - protein, 241 aa, Escherichia coli DEC15C; identical to SEQ ID NO: 6134

SEQ ID NO: 10641 - protein, 863 aa, Escherichia coli DEC15C; identical to SEQ ID NO: 10569

SEQ ID NO: 10642 - protein, 784 aa, Escherichia coli DEC15C; identical to SEQ ID NO: 6283

SEQ ID NO: 10643 - protein, 170 aa, Escherichia coli DEC15C [sequence omitted]

SEQ ID NO: 10644 - protein, 761 aa, Escherichia coli DEC15C
MQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 10645 - protein, 230 aa, Escherichia coli DEC15C; identical to SEQ ID NO: 7855

SEQ ID NO: 10646 - protein, 351 aa, Escherichia coli DEC15D; identical to SEQ ID NO: 5767

SEQ ID NO: 10647 - protein, 230 aa, Escherichia coli DEC15D; identical to SEQ ID NO: 7352

SEQ ID NO: 10648 - protein, 869 aa, Escherichia coli DEC15D; identical to SEQ ID NO: 10444

SEQ ID NO: 10649 - protein, 746 aa, Escherichia coli DEC15D; identical to SEQ ID NO: 10445

SEQ ID NO: 10650 - protein, 193 aa, Escherichia coli DEC15D; identical to SEQ ID NO: 6300

SEQ ID NO: 10651 - protein, 243 aa, Escherichia coli DEC15D; identical to SEQ ID NO: 6463

SEQ ID NO: 10652 - protein, 816 aa, Escherichia coli DEC15D; identical to SEQ ID NO: 6462

SEQ ID NO: 10653 - protein, 430 aa, Escherichia coli DEC15D; identical to SEQ ID NO: 5758

SEQ ID NO: 10654 - protein, 331 aa, Escherichia coli DEC15D; identical to SEQ ID NO: 6456

SEQ ID NO: 10655 - protein, 760 aa, Escherichia coli DEC15D; identical to SEQ ID NO: 6455

SEQ ID NO: 10656 - protein, 203 aa, Escherichia coli DEC15D; identical to SEQ ID NO: 6414

SEQ ID NO: 10657 - protein, 361 aa, Escherichia coli DEC15D; identical to SEQ ID NO: 7868

SEQ ID NO: 10658 - protein, 224 aa, Escherichia coli DEC15D; identical to SEQ ID NO: 7869

SEQ ID NO: 10659 - protein, 591 aa, Escherichia coli DEC15D; identical to SEQ ID NO: 9368

SEQ ID NO: 10660 - protein, 226 aa, Escherichia coli DEC15D
MIFAVLSLLVAGELQAGVVVGGTRFIFPADKESIAILLTNTSQESWLINSKINRPTRWAGGEVSTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQVIAQCHVAWRAINDYGGLSAKKEQNLP

SEQ ID NO: 10661 - protein, 849 aa, Escherichia coli DEC15D; identical to SEQ ID NO: 10457

SEQ ID NO: 10662 - protein, 250 aa, Escherichia coli DEC15D; identical to SEQ ID NO: 10456

SEQ ID NO: 10663 - protein, 669 aa, Escherichia coli DEC15D; identical to SEQ ID NO: 10458

SEQ ID NO: 10664 - protein, 517 aa, Escherichia coli DEC15D; identical to SEQ ID NO: 6406

SEQ ID NO: 10665 - protein, 191 aa, Escherichia coli DEC15D; identical to SEQ ID NO: 5748

SEQ ID NO: 10666 - protein, 232 aa, Escherichia coli DEC15D; identical to SEQ ID NO: 5747

SEQ ID NO: 10667 - protein, 729 aa, Escherichia coli DEC15D; identical to SEQ ID NO: 5745

SEQ ID NO: 10668 - protein, 213 aa, Escherichia coli DEC15D; identical to SEQ ID NO: 10463

SEQ ID NO: 10669 - protein, 485 aa, Escherichia coli DEC15D
MTVKISGVLKDGTGKPVQNCTIVLKARRTSSTVVVNTVASENPDEAGRYSMDVEHGQYSVTLLVEGFPPSHAGTITVYEDSRPGTLNDFLGAMTEDDARPEALRRFELMVEEVVRNAEEAKKNAGEAETSARNAGISASQAEESAANADTSAGDASESARQAAESAASAKQSEEASSSSASAAAQKASESLQSATDAELSKKTAESAAGNAARDATTATEKARESAESAQSAEQSRIAAEEAVNRIPTVVGPPGPKGEPGPAGPQGPKGDKGERGDTGPAGATGERGPAGDAGPAGPQGPKGDRGETGLTGAAGPAGPQGPKGDTGAAGPAGPQGPKGDTGAAGPAGPQGPKGDAGVAGPAGPQGPKGDTGAAGPAGPQGPKGDAGVAGPAGPQGPSGSPDSGLFGVGSFVLAAYYQTYYSGDRAPGSTVAGSSLSACCLSNGTPLVASGNVGETRLPGTWRACGPMLWTSSPGIRQAGLFQRIS

SEQ ID NO: 10670 - protein, 203 aa, Escherichia coli DEC15D; identical to SEQ ID NO: 6347

SEQ ID NO: 10671 - protein, 565 aa, Escherichia coli DEC15D; identical to SEQ ID NO: 6395

SEQ ID NO: 10672 - protein, 207 aa, Escherichia coli DEC15D; identical to SEQ ID NO: 5743

SEQ ID NO: 10673 - protein, 539 aa, Escherichia coli DEC15D
MAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPISDSTDPVDMRMYLRCQGDAISETWLYQYFPPAPDKRQYVDDRVMS

SEQ ID NO: 10674 - protein, 700 aa, Escherichia coli DEC15D; identical to SEQ ID NO: 7945

SEQ ID NO: 10675 - protein, 871 aa, Escherichia coli DEC15D
MHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSATNGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 10676 - protein, 224 aa, Escherichia coli DEC15D; identical to SEQ ID NO: 10471

SEQ ID NO: 10677 - protein, 111 aa, Escherichia coli DEC15D; identical to SEQ ID NO: 7885

SEQ ID NO: 10678 - protein, 118 aa, Escherichia coli DEC15D [sequence omitted]

SEQ ID NO: 10679 - protein, 360 aa, Escherichia coli DEC15D; identical to SEQ ID NO: 8317

SEQ ID NO: 10680 - protein, 395 aa, Escherichia coli DEC15D; identical to SEQ ID NO: 10474

SEQ ID NO: 10681 - protein, 673 aa, Escherichia coli DEC15D; identical to SEQ ID NO: 6170

SEQ ID NO: 10682 - protein, 826 aa, Escherichia coli DEC15D; identical to SEQ ID NO: 10483

SEQ ID NO: 10683 - protein, 224 aa, Escherichia coli DEC15D; identical to SEQ ID NO: 6435

SEQ ID NO: 10684 - protein, 641 aa, Escherichia coli DEC15D; identical to SEQ ID NO: 7667

SEQ ID NO: 10685 - protein, 162 aa, Escherichia coli DEC15D; identical to SEQ ID NO: 5896

SEQ ID NO: 10686 - protein, 367 aa, Escherichia coli DEC15D; identical to SEQ ID NO: 5784

SEQ ID NO: 10687 - protein, 200 aa, Escherichia coli DEC15D; identical to SEQ ID NO: 6311

SEQ ID NO: 10688 - protein, 274 aa, Escherichia coli DEC15D; identical to SEQ ID NO: 6549

SEQ ID NO: 10689 - protein, 250 aa, Escherichia coli DEC15D; identical to SEQ ID NO: 10481

SEQ ID NO: 10690 - protein, 880 aa, Escherichia coli DEC15D; identical to SEQ ID NO: 10545

SEQ ID NO: 10691 - protein, 518 aa, Escherichia coli DEC15D; identical to SEQ ID NO: 6358

SEQ ID NO: 10692 - protein, 121 aa, Escherichia coli DEC15D; identical to SEQ ID NO: 10464

SEQ ID NO: 10693 - protein, 359 aa, Escherichia coli DEC15D; identical to SEQ ID NO: 10488

SEQ ID NO: 10694 - protein, 686 aa, Escherichia coli DEC15D; identical to SEQ ID NO: 6453

SEQ ID NO: 10695 - protein, 834 aa, Escherichia coli DEC15D; identical to SEQ ID NO: 8715

SEQ ID NO: 10696 - protein, 249 aa, Escherichia coli DEC15D; identical to SEQ ID NO: 6450

SEQ ID NO: 10697 - protein, 94 aa, Escherichia coli DEC15D
MIYDASRKEAALPVANKGAETPYLLQSWVDNIDGTSRAPFIITPPLFRLEAGDDSSLRIIKTADNLPENKESLFYINVRAIPAKKNQMMLMLTS

SEQ ID NO: 10698 - protein, 721 aa, Escherichia coli DEC15D
MDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDENNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSRISSKSQSWTVRWGNQADQQCQFAFSTPDSEPTTSVLQGTAQCH

SEQ ID NO: 10699 - protein, 678 aa, Escherichia coli DEC15D; identical to SEQ ID NO: 7968

SEQ ID NO: 10700 - protein, 432 aa, Escherichia coli DEC15D; identical to SEQ ID NO: 5727

SEQ ID NO: 10701 - protein, 386 aa, Escherichia coli DEC15D; identical to SEQ ID NO: 7993

SEQ ID NO: 10702 - protein, 732 aa, Escherichia coli DEC15D; identical to SEQ ID NO: 10498

SEQ ID NO: 10703 - protein, 243 aa, Escherichia coli DEC15D; identical to SEQ ID NO: 6145

SEQ ID NO: 10704 - protein, 208 aa, Escherichia coli DEC15D; identical to SEQ ID NO: 5717

SEQ ID NO: 10705 - protein, 614 aa, Escherichia coli DEC15D; identical to SEQ ID NO: 6387

SEQ ID NO: 10706 - protein, 170 aa, Escherichia coli DEC15D [sequence omitted]

SEQ ID NO: 10707 - protein, 761 aa, Escherichia coli DEC15D; identical to SEQ ID NO: 10644

SEQ ID NO: 10708 - protein, 230 aa, Escherichia coli DEC15D; identical to SEQ ID NO: 7855

SEQ ID NO: 10709 - protein, 747 aa, Escherichia coli DEC15D; identical to SEQ ID NO: 6343

SEQ ID NO: 10710 - protein, 266 aa, Escherichia coli DEC15D; identical to SEQ ID NO: 5772

SEQ ID NO: 10711 - protein, 161 aa, Escherichia coli DEC15D; identical to SEQ ID NO: 5769

SEQ ID NO: 10712 - protein, 446 aa, Escherichia coli DEC15D; identical to SEQ ID NO: 6459

SEQ ID NO: 10713 - protein, 237 aa, Escherichia coli DEC15D; identical to SEQ ID NO: 6533

SEQ ID NO: 10714 - protein, 478 aa, Escherichia coli DEC15D; identical to SEQ ID NO: 5711

SEQ ID NO: 10715 - protein, 368 aa, Escherichia coli DEC15D; identical to SEQ ID NO: 7849

SEQ ID NO: 10716 - protein, 241 aa, Escherichia coli DEC15D; identical to SEQ ID NO: 6134

SEQ ID NO: 10717 - protein, 837 aa, Escherichia coli DEC15D; identical to SEQ ID NO: 10505

SEQ ID NO: 10718 - protein, 241 aa, Escherichia coli DEC15E; identical to SEQ ID NO: 6134

SEQ ID NO: 10719 - protein, 863 aa, Escherichia coli DEC15E; identical to SEQ ID NO: 10569

SEQ ID NO: 10720 - protein, 784 aa, Escherichia coli DEC15E; identical to SEQ ID NO: 6283

SEQ ID NO: 10721 - protein, 170 aa, Escherichia coli DEC15E [sequence omitted]

SEQ ID NO: 10722 - protein, 765 aa, Escherichia coli DEC15E; identical to SEQ ID NO: 8790

SEQ ID NO: 10723 - protein, 230 aa, Escherichia coli DEC15E; identical to SEQ ID NO: 7855

SEQ ID NO: 10724 - protein, 747 aa, Escherichia coli DEC15E; identical to SEQ ID NO: 6343

SEQ ID NO: 10725 - protein, 266 aa, Escherichia coli DEC15E; identical to SEQ ID NO: 5772

SEQ ID NO: 10726 - protein, 161 aa, Escherichia coli DEC15E; identical to SEQ ID NO: 5769

SEQ ID NO: 10727 - protein, 351 aa, Escherichia coli DEC15E; identical to SEQ ID NO: 5767

SEQ ID NO: 10728 - protein, 230 aa, Escherichia coli DEC15E; identical to SEQ ID NO: 7352

SEQ ID NO: 10729 - protein, 869 aa, Escherichia coli DEC15E; identical to SEQ ID NO: 10444

SEQ ID NO: 10730 - protein, 746 aa, Escherichia coli DEC15E; identical to SEQ ID NO: 10445

SEQ ID NO: 10731 - protein, 193 aa, Escherichia coli DEC15E; identical to SEQ ID NO: 6300

SEQ ID NO: 10732 - protein, 331 aa, Escherichia coli DEC15E; identical to SEQ ID NO: 6456

SEQ ID NO: 10733 - protein, 243 aa, Escherichia coli DEC15E; identical to SEQ ID NO: 6463

SEQ ID NO: 10734 - protein, 816 aa, Escherichia coli DEC15E; identical to SEQ ID NO: 6462

SEQ ID NO: 10735 - protein, 430 aa, Escherichia coli DEC15E; identical to SEQ ID NO: 5758

SEQ ID NO: 10736 - protein, 760 aa, Escherichia coli DEC15E; identical to SEQ ID NO: 6455

SEQ ID NO: 10737 - protein, 224 aa, Escherichia coli DEC15E; identical to SEQ ID NO: 7869

SEQ ID NO: 10738 - protein, 591 aa, Escherichia coli DEC15E
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQVKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKITPG

SEQ ID NO: 10739 - protein, 226 aa, Escherichia coli DEC15E; identical to SEQ ID NO: 10660

SEQ ID NO: 10740 - protein, 203 aa, Escherichia coli DEC15E; identical to SEQ ID NO: 6414

SEQ ID NO: 10741 - protein, 361 aa, Escherichia coli DEC15E; identical to SEQ ID NO: 7868

SEQ ID NO: 10742 - protein, 485 aa, Escherichia coli DEC15E; identical to SEQ ID NO: 10669

SEQ ID NO: 10743 - protein, 210 aa, Escherichia coli DEC15E
MKIRTALLVSSLPLCFFVSANAKTFENEGNKTQMFSLHLGATRVIYNIFSSGETLTIINDHDYPMLVQSEVLLEDQKTPAPFIITPPLFRLDALQSSRLRIVRTGGDFPKDRETLQWICVKGIPPKSDEKWAESNKNSLNNVTLNVQVSLSTCIKMFVRPSSVKGHPEDVAGEVKWQRVNNKLKGVNPTPFYINLSELRVGGKKYLNIII

SEQ ID NO: 10744 - protein, 730 aa, Escherichia coli DEC15E
DERQCADLSVIPQATEEFLFEAQKLVLSIPQVAIRSPLRGVASDLIWEDGISTFLLNWQVEAGHSEFQHYEKTTSDNFWASLEPGINIGPWRIRNLTTLNKSSGQVGKWESSYIRAERGLNNIKSRLTLGEDYTPADIFASVPFRGVMLGTDENMIPYNQRGFAPVIRGIARTQARIEIRQNGYLIQSQTVAAGPFALTDLPITGSGGEFQVTIFESDGAIQSFNVPFTTPAIALREGYLKYNISAGQYRSSDESVEKAYLWQATAMYGLPRALTVFGGVQTAEHYQAAALGVGLSLGNMGAASLDTIYSRGQQKGYDFDTGNSWRIRYDKSFKLTDTSFSAASYQYSNEGYHELSDILDTYRSGANFVFNDTDRKRRRITININQSLGPWGFIGLSGGRDEYKGGDRQDYIGASYSMSWKDISFSVNWTRNRNVGDYFSNRTFNEDTVGMWMSIPLKHWLGKNDNDVNATAQIQHSTRQNTRYEMGLNGRAFDQKLYWDIREQIVPGSKYDADTSRLNMRWSGSYGELVGMYSYNSHTRQMNAGMSGSIAMHSEGITFGQRFGDTMALIAAPGVRGASVGGWPGVSTDSRGYALVSYITPYQENIITLDPTTFPENAEVLQTDTRVVPTKGAVVRAKFKTRVGNRAVVRLARADGTPLPFGTVVTLEGKTEVSNSTGVVDDKGMVYLSGLSEAGKLKAQWGMNSHCYANYRLPVKKGPAGLYLTSAVCI

SEQ ID NO: 10745 - protein, 669 aa, Escherichia coli DEC15E; identical to SEQ ID NO: 10458

SEQ ID NO: 10746 - protein, 517 aa, Escherichia coli DEC15E; identical to SEQ ID NO: 6406

SEQ ID NO: 10747 - protein, 191 aa, Escherichia coli DEC15E; identical to SEQ ID NO: 5748

SEQ ID NO: 10748 - protein, 203 aa, Escherichia coli DEC15E; identical to SEQ ID NO: 6347

SEQ ID NO: 10749 - protein, 565 aa, Escherichia coli DEC15E; identical to SEQ ID NO: 6395

SEQ ID NO: 10750 - protein, 207 aa, Escherichia coli DEC15E; identical to SEQ ID NO: 5743

SEQ ID NO: 10751 - protein, 232 aa, Escherichia coli DEC15E; identical to SEQ ID NO: 5747

SEQ ID NO: 10752 - protein, 686 aa, Escherichia coli DEC15E
MIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 10753 - protein, 213 aa, Escherichia coli DEC15E; identical to SEQ ID NO: 10463

SEQ ID NO: 10754 - protein, 539 aa, Escherichia coli DEC15E; identical to SEQ ID NO: 6525

SEQ ID NO: 10755 - protein, 700 aa, Escherichia coli DEC15E; identical to SEQ ID NO: 7945

SEQ ID NO: 10756 - protein, 224 aa, Escherichia coli DEC15E; identical to SEQ ID NO: 10471

SEQ ID NO: 10757 - protein, 111 aa, Escherichia coli DEC15E; identical to SEQ ID NO: 7885

SEQ ID NO: 10758 - protein, 130 aa, Escherichia coli DEC15E; identical to SEQ ID NO: 7726

SEQ ID NO: 10759 - protein, 360 aa, Escherichia coli DEC15E; identical to SEQ ID NO: 8317

SEQ ID NO: 10760 - protein, 395 aa, Escherichia coli DEC15E; identical to SEQ ID NO: 10474

SEQ ID NO: 10761 - protein, 673 aa, Escherichia coli DEC15E; identical to SEQ ID NO: 6170

SEQ ID NO: 10762 - protein, 641 aa, Escherichia coli DEC15E; identical to SEQ ID NO: 7667

SEQ ID NO: 10763 - protein, 162 aa, Escherichia coli DEC15E; identical to SEQ ID NO: 5896

SEQ ID NO: 10764 - protein, 367 aa, Escherichia coli DEC15E; identical to SEQ ID NO: 5784

SEQ ID NO: 10765 - protein, 200 aa, Escherichia coli DEC15E; identical to SEQ ID NO: 6311

SEQ ID NO: 10766 - protein, 518 aa, Escherichia coli DEC15E; identical to SEQ ID NO: 6358

SEQ ID NO: 10767 - protein, 672 aa, Escherichia coli DEC15E
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGALIWRTVFPKRLL

SEQ ID NO: 10768 - protein, 224 aa, Escherichia coli DEC15E; identical to SEQ ID NO: 6435

SEQ ID NO: 10769 - protein, 274 aa, Escherichia coli DEC15E; identical to SEQ ID NO: 6549

SEQ ID NO: 10770 - protein, 250 aa, Escherichia coli DEC15E; identical to SEQ ID NO: 10481

SEQ ID NO: 10771 - protein, 880 aa, Escherichia coli DEC15E; identical to SEQ ID NO: 10545

SEQ ID NO: 10772 - protein, 432 aa, Escherichia coli DEC15E; identical to SEQ ID NO: 5727

SEQ ID NO: 10773 - protein, 359 aa, Escherichia coli DEC15E; identical to SEQ ID NO: 10488

SEQ ID NO: 10774 - protein, 686 aa, Escherichia coli DEC15E; identical to SEQ ID NO: 6453

SEQ ID NO: 10775 - protein, 834 aa, Escherichia coli DEC15E; identical to SEQ ID NO: 8715

SEQ ID NO: 10776 - protein, 157 aa, Escherichia coli DEC15E
MISQEKIAQLPNDRETLFYFNVREIPPKTDKKNVMQVTMQHALKLFWRPKAIELEDDGVMSYEKVEIIRRNDGSIRFNNKMPYHVTLGYIGTNGITMLPQTQSLMVTPYSHADTQFKNVPSAFQVGYINDFGGLSFYEINCPTVNNSCNVSVAKRDK

SEQ ID NO: 10777 - protein, 231 aa, Escherichia coli DEC15E; identical to SEQ ID NO: 6351

SEQ ID NO: 10778 - protein, 721 aa, Escherichia coli DEC15E; identical to SEQ ID NO: 10698

SEQ ID NO: 10779 - protein, 678 aa, Escherichia coli DEC15E; identical to SEQ ID NO: 7968

SEQ ID NO: 10780 - protein, 386 aa, Escherichia coli DEC15E; identical to SEQ ID NO: 7993

SEQ ID NO: 10781 - protein, 732 aa, Escherichia coli DEC15E; identical to SEQ ID NO: 10498

SEQ ID NO: 10782 - protein, 208 aa, Escherichia coli DEC15E; identical to SEQ ID NO: 5717

SEQ ID NO: 10783 - protein, 614 aa, Escherichia coli DEC15E; identical to SEQ ID NO: 6387

SEQ ID NO: 10784 - protein, 478 aa, Escherichia coli DEC15E; identical to SEQ ID NO: 5711

SEQ ID NO: 10785 - protein, 446 aa, Escherichia coli DEC15E; identical to SEQ ID NO: 6459

SEQ ID NO: 10786 - protein, 237 aa, Escherichia coli DEC15E; identical to SEQ ID NO: 6533

SEQ ID NO: 10787 - protein, 368 aa, Escherichia coli DEC15E; identical to SEQ ID NO: 7849

SEQ ID NO: 10788 - protein, 94 aa, Escherichia coli DEC15E
MLRLARAVIPAAVLMMFFPQLAMAAQGAGQDLMQSGNSTVKATFGKDSSVVKWVVLAEVLVGAVMYMMTKNVKFLAGFAIISVFIAVGMAVVGL

SEQ ID NO: 10789 - protein, 161 aa, Escherichia coli DEC1A; identical to SEQ ID NO: 5769

SEQ ID NO: 10790 - protein, 170 aa, Escherichia coli DEC1A; identical to SEQ ID NO: 7801

SEQ ID NO: 10791 - protein, 790 aa, Escherichia coli DEC1A; identical to SEQ ID NO: 7802

SEQ ID NO: 10792 - protein, 200 aa, Escherichia coli DEC1A; identical to SEQ ID NO: 7803

SEQ ID NO: 10793 - protein, 705 aa, Escherichia coli DEC1A
MSVYAQAAVEPKEDTITVTAAPAPQESAWGPAATIAAKHSATATKTDTPIEKTPQSISVVTREEMDIKQPATVKEALDYTPSVFSTRGSSTTYDVVSIRGFTTASTVNTNQYLDGLKLQGDNYSEASIDPYFLERVELLRGPVSVLYGKSHPGGVVSMVSKRPSTDPIKEIQFKMGTDNLWQTGFDFSDAIDDDGVWSYRLTGLGRSQDAQQKYAKTTRYAVAPSFSWRPDDKTDFTFLSNFQSDPDAGYYGWLPRQGTVVPYQDANGSWHKLPTDFNEGEKDNKMSRRQQLIGYSFAHEFNDTFTVRQNLRYTRIHTLYDAVYGNGYIAPAQISRAYVRSDEDLNSFTVDTQLQSNFAIGAVAHTLLTGVDYLRMRNDIDANYGTANPISMTDPQYGNANININFPYAVINRQEQTGLYIQDQSEWNKWVLTLGGRYDFAKTSTYTRSTSSLDEINDQQFTWRGGINYLFDNGISPYFSYSESFEPVSGATKEGKPFDPSRGKQYEAGVKYVPKDTPVTVTASVFQLTKDKNLTADPSNTLFSVQGGEIRSRGFEIEAKAAVNANINVTAAYSYTDAEYTKDTLYKGKRPAEVPRNMASLWADYTFHETALSGLSLGAGARYFGDTSSFYTTGDKTNQTFNVGGYTLVDAMIKYDIARFGMPGSSVGVNVNNLFDREYVSSCYRDYACYWGAERQVVATATFRF

SEQ ID NO: 10794 - protein, 266 aa, Escherichia coli DEC1A; identical to SEQ ID NO: 7806

SEQ ID NO: 10795 - protein, 351 aa, Escherichia coli DEC1A; identical to SEQ ID NO: 7789

SEQ ID NO: 10796 - protein, 193 aa, Escherichia coli DEC1A; identical to SEQ ID NO: 6300

SEQ ID NO: 10797 - protein, 746 aa, Escherichia coli DEC1A; identical to SEQ ID NO: 7788

SEQ ID NO: 10798 - protein, 331 aa, Escherichia coli DEC1A; identical to SEQ ID NO: 7841

SEQ ID NO: 10799 - protein, 760 aa, Escherichia coli DEC1A
MENNRNFPAGQFHSLTFFAGLCIGITPVAQALAAEGQANADDTLVVEASTPSLYAPQKSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRNKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 10800 - protein, 203 aa, Escherichia coli DEC1A; identical to SEQ ID NO: 6414

SEQ ID NO: 10801 - protein, 355 aa, Escherichia coli DEC1A; identical to SEQ ID NO: 7838

SEQ ID NO: 10802 - protein, 191 aa, Escherichia coli DEC1A; identical to SEQ ID NO: 5748

SEQ ID NO: 10803 - protein, 232 aa, Escherichia coli DEC1A; identical to SEQ ID NO: 5747

SEQ ID NO: 10804 - protein, 729 aa, Escherichia coli DEC1A; identical to SEQ ID NO: 7833

SEQ ID NO: 10805 - protein, 213 aa, Escherichia coli DEC1A; identical to SEQ ID NO: 5744

SEQ ID NO: 10806 - protein, 203 aa, Escherichia coli DEC1A; identical to SEQ ID NO: 7809

SEQ ID NO: 10807 - protein, 656 aa, Escherichia coli DEC1A; identical to SEQ ID NO: 7810

SEQ ID NO: 10808 - protein, 565 aa, Escherichia coli DEC1A; identical to SEQ ID NO: 7811

SEQ ID NO: 10809 - protein, 207 aa, Escherichia coli DEC1A; identical to SEQ ID NO: 7812

SEQ ID NO: 10810 - protein, 539 aa, Escherichia coli DEC1A
MAAVCGTSGIASLFSQAAFAADSDIADGQTQRFDLSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKNQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 10811 - protein, 700 aa, Escherichia coli DEC1A
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDFDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTLSTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTIYKNAGKTRRQGAELAWDQRFAGDFRVKASWTWLDATYRSNVCNEQDCNGNRMPGIARNMAFASIGYIPEDGWYAGTEARYMGDIMADDENTAKAPSYTLVGLFTGYKYNYHNLTVDLFGRVDNLFDKEYVGSVIVNESNGRYYEPAPGRNYGVGINIAWRFE

SEQ ID NO: 10812 - protein, 239 aa, Escherichia coli DEC1A
MHQMQTTRTPYSISFMATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 10813 - protein, 118 aa, Escherichia coli DEC1A [sequence omitted]

SEQ ID NO: 10814 - protein, 111 aa, Escherichia coli DEC1A
MKKQIEGMTMKKVLALVVAAAMGLSSAAFAAETATTPAPTATTTKAAPAKTTHHKKQHKAAPAQKAQAAKKHHKNAKAEQKAPEQKAQAAKKHARKHSHQQPAKPAAQPAA

SEQ ID NO: 10815 - protein, 826 aa, Escherichia coli DEC1A; identical to SEQ ID NO: 7836

SEQ ID NO: 10816 - protein, 165 aa, Escherichia coli DEC1A; identical to SEQ ID NO: 7837

SEQ ID NO: 10817 - protein, 650 aa, Escherichia coli DEC1A
MSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKIENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 10818 - protein, 162 aa, Escherichia coli DEC1A; identical to SEQ ID NO: 5896

SEQ ID NO: 10819 - protein, 371 aa, Escherichia coli DEC1A; identical to SEQ ID NO: 7822

SEQ ID NO: 10820 - protein, 200 aa, Escherichia coli DEC1A; identical to SEQ ID NO: 5898

SEQ ID NO: 10821 - protein, 274 aa, Escherichia coli DEC1A; identical to SEQ ID NO: 5899

SEQ ID NO: 10822 - protein, 249 aa, Escherichia coli DEC1A; identical to SEQ ID NO: 7817

SEQ ID NO: 10823 - protein, 879 aa, Escherichia coli DEC1A; identical to SEQ ID NO: 7818

SEQ ID NO: 10824 - protein, 518 aa, Escherichia coli DEC1A; identical to SEQ ID NO: 7565

SEQ ID NO: 10825 - protein, 432 aa, Escherichia coli DEC1A; identical to SEQ ID NO: 5727

SEQ ID NO: 10826 - protein, 359 aa, Escherichia coli DEC1A; identical to SEQ ID NO: 5847

SEQ ID NO: 10827 - protein, 616 aa, Escherichia coli DEC1A
MGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 10828 - protein, 711 aa, Escherichia coli DEC1A; identical to SEQ ID NO: 8259

SEQ ID NO: 10829 - protein, 386 aa, Escherichia coli DEC1A; identical to SEQ ID NO: 7828

SEQ ID NO: 10830 - protein, 613 aa, Escherichia coli DEC1A; identical to SEQ ID NO: 7827

SEQ ID NO: 10831 - protein, 859 aa, Escherichia coli DEC1A
MSWMVVSRTYTSFFPFSLSVLALTVAGSFSATAGKFNPRFLEDTAGINQHVDLSMYETDHGAQLPGTYRVSLIVNEQKMETRTLEFKAATESQRKEMGEFLIPCLSRTQLADMGVRVDSFSALNLIPAEACVAFNEIIPQATSHFDFSEQKLVMSFPQAAMQQVARGTVPESRWDDGVPALLLDYSFSGSNSSHDTKSYNRYIDENGNHHQDKNETSQTNDSYYLSMRSGLNLGAWRLRNYSNWSYSNGEKQWDNIGTYVTRAIVPLKAQLTLGDTATPSDIFDSVQMRGALLASDEEMLPDSQRGFAPVVRGIAKSNAEVSIEQNGYVIYRAFVQPGAFEINDLYPTANSGDLTVIVKEADGSEQRFIQPFSSVAVFQREGHLKYSLSAGEYRAGNYDSANPRFGQFNAMYGLPFGMTTYGGALISKDYNAFALGLGKNFGSIGAISVDITQAKSTLNNNATDQGQSYRFLYSKSFASGTDFRLLGYKYSTSGFYTFQEATDVRSGADSDYGRYHKRSEIQGNLTQQLGTYGSVYFNMTQQDYWNDDGKRLSLATGYNGRIGRVNYSIAYSWNKSPEWDENDQLWSFNISIPFGRAWSNYRVTTDQDGRTIQQLGVNGTLLEDRNLSYNVQEGYSSNGVGNSGNASLAYQGGAGNISVGYSYGKDYQQTNYSLRGGIVAHSEGISLSQPLGETIAIVSAPGARGAKVLNNSGVSVDWQGNAVVPYLSIYRENDVSIRSETLNDSVDMNSAFQTIVPTRGAVVRAHFDTRVGYRVLMTLIRQNGVSVPFGATATLVSDTTEQISGIVGEDGQLYISGMPKTGNVKIVWGKDTSQQCVAKYELPVEEKNSGIISVTANCQ

SEQ ID NO: 10832 - protein, 199 aa, Escherichia coli DEC1A; identical to SEQ ID NO: 7825

SEQ ID NO: 10833 - protein, 512 aa, Escherichia coli DEC1A; identical to SEQ ID NO: 6120

SEQ ID NO: 10834 - protein, 208 aa, Escherichia coli DEC1A; identical to SEQ ID NO: 5869

SEQ ID NO: 10835 - protein, 446 aa, Escherichia coli DEC1A; identical to SEQ ID NO: 5873

SEQ ID NO: 10836 - protein, 774 aa, Escherichia coli DEC1A; identical to SEQ ID NO: 6673

SEQ ID NO: 10837 - protein, 368 aa, Escherichia coli DEC1A; identical to SEQ ID NO: 7797

SEQ ID NO: 10838 - protein, 241 aa, Escherichia coli DEC1A; identical to SEQ ID NO: 6140

SEQ ID NO: 10839 - protein, 856 aa, Escherichia coli DEC1A; identical to SEQ ID NO: 7799

SEQ ID NO: 10840 - protein, 170 aa, Escherichia coli DEC1B; identical to SEQ ID NO: 7801

SEQ ID NO: 10841 - protein, 798 aa, Escherichia coli DEC1B
MYINDQPIMSQSIAFTVIEGKKNAQACITQKNLLQFHISSPDKNSGKAILLKRDDDLGDCLNLAEMISQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLDTDHRSSGFQSIDTQLNSDFKGNNQLNISSSGYSDTNRISYSVNTGYMMNKSSDDLSYIGGHASYESPWGTLSGSASASSDNSRQFSLNTDGGFVLHSGGLTFSNDSFSDSDTLAVIQAPGAKGARINYGNSTVDRWSYGVTSALSPYHENRIALDINDLENDVELKSTSTVAIPRQGAVVFADFETVQGQSAIMNIVRSDGKNIPFAEDIYDEQNNIIGNVGQGGQAFVHGIEQEENIRITWIEEGKPVSCFAHYQQNTASEKIAQSIILNGLRCQIQ

SEQ ID NO: 10842 - protein, 200 aa, Escherichia coli DEC1B; identical to SEQ ID NO: 7803

SEQ ID NO: 10843 - protein, 193 aa, Escherichia coli DEC1B
NKDAYARYLVQSWVSNIDGSKAPFLITPPVYKLEENRQTLLHIVFTGDKDKLPQDRESLFLANVKSVSAMPEELKDKNILQFAMKARLKLFWRPVSLDNNDALTAWEKLKFHKEAGKLIVKNPTPFYISFNDLTVSGKNIVPVDTKSEPGALLMMVGPFSEQRFSLPAGAGNVVEWSVITDYGSSSGKRKQKL

SEQ ID NO: 10844 - protein, 731 aa, Escherichia coli DEC1B; identical to SEQ ID NO: 7805

SEQ ID NO: 10845 - protein, 266 aa, Escherichia coli DEC1B; identical to SEQ ID NO: 7806

SEQ ID NO: 10846 - protein, 161 aa, Escherichia coli DEC1B; identical to SEQ ID NO: 5769

SEQ ID NO: 10847 - protein, 351 aa, Escherichia coli DEC1B; identical to SEQ ID NO: 7789

SEQ ID NO: 10848 - protein, 746 aa, Escherichia coli DEC1B; identical to SEQ ID NO: 7788

SEQ ID NO: 10849 - protein, 193 aa, Escherichia coli DEC1B; identical to SEQ ID NO: 6300

SEQ ID NO: 10850 - protein, 430 aa, Escherichia coli DEC1B; identical to SEQ ID NO: 5758

SEQ ID NO: 10851 - protein, 331 aa, Escherichia coli DEC1B; identical to SEQ ID NO: 7841

SEQ ID NO: 10852 - protein, 760 aa, Escherichia coli DEC1B; identical to SEQ ID NO: 10799

SEQ ID NO: 10853 - protein, 203 aa, Escherichia coli DEC1B; identical to SEQ ID NO: 6414

SEQ ID NO: 10854 - protein, 355 aa, Escherichia coli DEC1B; identical to SEQ ID NO: 7838

SEQ ID NO: 10855 - protein, 826 aa, Escherichia coli DEC1B; identical to SEQ ID NO: 7836

SEQ ID NO: 10856 - protein, 165 aa, Escherichia coli DEC1B; identical to SEQ ID NO: 7837

SEQ ID NO: 10857 - protein, 191 aa, Escherichia coli DEC1B; identical to SEQ ID NO: 5748

SEQ ID NO: 10858 - protein, 232 aa, Escherichia coli DEC1B; identical to SEQ ID NO: 5747

SEQ ID NO: 10859 - protein, 729 aa, Escherichia coli DEC1B; identical to SEQ ID NO: 7833

SEQ ID NO: 10860 - protein, 213 aa, Escherichia coli DEC1B; identical to SEQ ID NO: 5744

SEQ ID NO: 10861 - protein, 203 aa, Escherichia coli DEC1B; identical to SEQ ID NO: 7809

SEQ ID NO: 10862 - protein, 656 aa, Escherichia coli DEC1B; identical to SEQ ID NO: 7810

SEQ ID NO: 10863 - protein, 565 aa, Escherichia coli DEC1B; identical to SEQ ID NO: 7811

SEQ ID NO: 10864 - protein, 207 aa, Escherichia coli DEC1B; identical to SEQ ID NO: 7812

SEQ ID NO: 10865 - protein, 407 aa, Escherichia coli DEC1B
MTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVNDAVANIPQPADGKSLTPDDVRPMLEQMVKEAVSHIHVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGGGK

SEQ ID NO: 10866 - protein, 391 aa, Escherichia coli DEC1B
MTVKISGVLKDGTGKPVQNCTIVLKARRTSSTVVVNTVASENPDEAGRYSMDVEHGQYSVTLLVEGFPPSHAGTITVYEGSRPGTLNDFLGAMTEDDVRPEALRRFELMVEEAARHAEEAKKNAGEAETSARNAGISASQAEESAANADTSAGDASESARQAAESAAAAKQSEEASSSSASAAAQKASESSQSAADAELSKKTAESAAGNAARDATTATEKARESAESAQSAEQSRIAAEEAVNRIPTVVGPPGPKGEPGPAGPQGPKGDKGERGDTGPAGATGERGPAGDAGPAGPQGPKGDRGERGETGLTGNAGPQGPKGDTGAAGPAGPQGPKGETGAAGPVGATGPQGPKGDPGRHKSVFVWGRRALLRQTAMAGSRIQMAHSSPD

SEQ ID NO: 10867 - protein, 539 aa, Escherichia coli DEC1B; identical to SEQ ID NO: 10810

SEQ ID NO: 10868 - protein, 700 aa, Escherichia coli DEC1B; identical to SEQ ID NO: 10811

SEQ ID NO: 10869 - protein, 871 aa, Escherichia coli DEC1B
MHQVLLLPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSADKHAPDNSACTPLQDRLADASSEFDVGQQHLSLSVPQIYVGRMARGYVSPDLWEEGINAGLLNYSFNGNSINNRSNHNAGKSNYAYLNLQSGINIGSWQLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQITVPPGPFTIDDINSAANGGDLQVTIKEADGSIQTLYVPYSSVPVLQRAGYTCYALAMGEYRSGNNLQSSPKFIQGSLMHGLEGNWTPYGGMQIAENYQAFNLGIGKDLGLFGAFSFDITQANTTLADDTRHSGQSLKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNIGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPAVSPGTLLNQQTAICR

SEQ ID NO: 10870 - protein, 236 aa, Escherichia coli DEC1B; identical to SEQ ID NO: 7814

SEQ ID NO: 10871 - protein, 386 aa, Escherichia coli DEC1B
MDNAPLPQVISMVWQRVFNRPYQLSPDIAGDTRLVSFYLSKNQEPRSFFISYLKRLNISVTSMKDGVDYISVIKQTEQKVPDVVFTYRPKYRSVSYLSAMLNSVVSSGAFSNHIQSVDYLSGGVSGITTTDSASTRMSIATDAEVLVYSGPAASVRQIEKILPRIDVPAEQVTVSGYVLEVQTTDRNATGLQIIADLFRNKLGMSVGARLDGGNSFTLNVGGLNAFYSLIKEDSRFNVVSNPRLTVLSGSKSQFTVGQEVPVLDSVSYQGSSGTPVQSVTYRNSGAIFTVTPVVLDGLITPDISQQLSDFVKTTTGVNSSPTLTKREISTKVDVKDGELLVLGGLASSKLTQSRTGFSFLPGFTGKSDENNRTDIIVVLQARRVGK

SEQ ID NO: 10872 - protein, 111 aa, Escherichia coli DEC1B; identical to SEQ ID NO: 10814

SEQ ID NO: 10873 - protein, 118 aa, Escherichia coli DEC1B [sequence omitted]

SEQ ID NO: 10874 - protein, 200 aa, Escherichia coli DEC1B; identical to SEQ ID NO: 5898

SEQ ID NO: 10875 - protein, 274 aa, Escherichia coli DEC1B; identical to SEQ ID NO: 5899

SEQ ID NO: 10876 - protein, 249 aa, Escherichia coli DEC1B; identical to SEQ ID NO: 7817

SEQ ID NO: 10877 - protein, 879 aa, Escherichia coli DEC1B; identical to SEQ ID NO: 7818

SEQ ID NO: 10878 - protein, 641 aa, Escherichia coli DEC1B; identical to SEQ ID NO: 7819

SEQ ID NO: 10879 - protein, 162 aa, Escherichia coli DEC1B; identical to SEQ ID NO: 5896

SEQ ID NO: 10880 - protein, 371 aa, Escherichia coli DEC1B; identical to SEQ ID NO: 7822

SEQ ID NO: 10881 - protein, 518 aa, Escherichia coli DEC1B; identical to SEQ ID NO: 7565

SEQ ID NO: 10882 - protein, 432 aa, Escherichia coli DEC1B; identical to SEQ ID NO: 5727

SEQ ID NO: 10883 - protein, 359 aa, Escherichia coli DEC1B; identical to SEQ ID NO: 5847

SEQ ID NO: 10884 - protein, 686 aa, Escherichia coli DEC1B; identical to SEQ ID NO: 7831

SEQ ID NO: 10885 - protein, 711 aa, Escherichia coli DEC1B; identical to SEQ ID NO: 8259

SEQ ID NO: 10886 - protein, 678 aa, Escherichia coli DEC1B; identical to SEQ ID NO: 7829

SEQ ID NO: 10887 - protein, 386 aa, Escherichia coli DEC1B; identical to SEQ ID NO: 8261

SEQ ID NO: 10888 - protein, 660 aa, Escherichia coli DEC1B
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFSVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 10889 - protein, 859 aa, Escherichia coli DEC1B; identical to SEQ ID NO: 10831

SEQ ID NO: 10890 - protein, 138 aa, Escherichia coli DEC1B
MNPSLPQDRESVYWVNVKAIPSQNEENEGKNVLQIAVRTRIKLFYRPAGLKGDIKSSPGELRFTRNGKQIKVDNPTVFNITFSDVFINGHEIEKSGMVPAKGALNIYLPAGVNSASQIKYNTINDFGSSGEYLTREIN

SEQ ID NO: 10891 - protein, 514 aa, Escherichia coli DEC1B
MCNEKNKFFIFTALFCCSAQAAPSSLEKRLGKNEYFIITKSSPVRAILNDFAANYSIPVFISSSVNDDFSGEIKNEKPVKVLEKLSKLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQANISSSVISNASNFMIRVNALQQNSKAKILSQPSIITLNNMQAILDKNVTFYTKVSGEKVASLESITSGTLLRVTPRILDDSSNSLTGKRRERVRLLLDIQDGNQSTNQSNAQDASSTLPEVQNSEMTTEATLSAGESLLLGGFIQDKESSSKDGIPLLSDIPVIGSLFSSTVKQKHSVVRLFLIKATPIKSASSE

SEQ ID NO: 10892 - protein, 208 aa, Escherichia coli DEC1B; identical to SEQ ID NO: 5869

SEQ ID NO: 10893 - protein, 446 aa, Escherichia coli DEC1B; identical to SEQ ID NO: 5873

SEQ ID NO: 10894 - protein, 237 aa, Escherichia coli DEC1B; identical to SEQ ID NO: 7546

SEQ ID NO: 10895 - protein, 368 aa, Escherichia coli DEC1B; identical to SEQ ID NO: 7797

SEQ ID NO: 10896 - protein, 241 aa, Escherichia coli DEC1B; identical to SEQ ID NO: 6140

SEQ ID NO: 10897 - protein, 856 aa, Escherichia coli DEC1B; identical to SEQ ID NO: 7799

SEQ ID NO: 10898 - protein, 774 aa, Escherichia coli DEC1B; identical to SEQ ID NO: 6673

SEQ ID NO: 10899 - protein, 121 aa, Escherichia coli DEC1B
MNTVLSVQGASAPVKKKSFFSKFTRLNMLRLARAVIPAAVLMMFFPQLAMAAQGAGQDLMQSGNSTVKATFGKDSSVVKWVVLAEVLVGAVMYMMTKNVKFLAGFAIISVFIAVGMAVVGL

SEQ ID NO: 10900 - protein, 774 aa, Escherichia coli DEC1C; identical to SEQ ID NO: 6673

SEQ ID NO: 10901 - protein, 170 aa, Escherichia coli DEC1C; identical to SEQ ID NO: 7801

SEQ ID NO: 10902 - protein, 798 aa, Escherichia coli DEC1C; identical to SEQ ID NO: 10841

SEQ ID NO: 10903 - protein, 200 aa, Escherichia coli DEC1C; identical to SEQ ID NO: 7803

SEQ ID NO: 10904 - protein, 238 aa, Escherichia coli DEC1C; identical to SEQ ID NO: 7804

SEQ ID NO: 10905 - protein, 594 aa, Escherichia coli DEC1C
MARSKTAQPKHSLRKIAVVVATAVSGMSVYAQAAVEPKEDTITVTAAPAPQESAWGPAATIAAKHSATATKTDTPIEKTPQSISVVTREEMDIKQPATVKEALDYTPSVFSTRGSSTTYDVVSIRGFTTASTVNTNQYLDGLKLQGDNYSEASIDPYFLERVELLRGPVSVLYGKSHPGGVVSMVSKRPSTDPIKEIQFKMGTDNLWQTGFDFSDAIDDDGVWSYRLTGLGRSQDAQQKYAKTTRYAVAPSFSWRPDDKTDFTFLSNFQSDPDAGYYGWLPRQGTVVPYQDANGSWHKLPTDFNEGEKDNKMSRRQQLIGYSFAHEFNDTFTVRQNLRYTRIHTLYDAVYGNGYIAPAQISRAYVRSDEDLNSFTVDTQLQSNFAIGAVAHTLLTGVDYLRMRNDIDANYGTANPISMTDPQYGNANININFPYAVINRQEQTGLYIQDQSEWNKWVLTLGGRYDFAKTSTYTRSTSSLDEINDQQFTWRGGINYLFDNGISPYFSYSESFEPVSGATKEGKPFDPSRGKQYEAGVKYVPKDTPVTVTASVFQLTKDKNLTADPSNTLFSVQGGRFVLVALRLRPKQLSTLISM

SEQ ID NO: 10906 - protein, 54 aa, Escherichia coli DEC1C
MIKYDIARFGMPGSSVGVNVNNLFDREYVSSCYRDYACYWGAERQVVATATFRF

SEQ ID NO: 10907 - protein, 266 aa, Escherichia coli DEC1C; identical to SEQ ID NO: 7806

SEQ ID NO: 10908 - protein, 161 aa, Escherichia coli DEC1C; identical to SEQ ID NO: 5769

SEQ ID NO: 10909 - protein, 351 aa, Escherichia coli DEC1C; identical to SEQ ID NO: 7789

SEQ ID NO: 10910 - protein, 746 aa, Escherichia coli DEC1C; identical to SEQ ID NO: 7788

SEQ ID NO: 10911 - protein, 193 aa, Escherichia coli DEC1C; identical to SEQ ID NO: 6300

SEQ ID NO: 10912 - protein, 430 aa, Escherichia coli DEC1C; identical to SEQ ID NO: 5758

SEQ ID NO: 10913 - protein, 331 aa, Escherichia coli DEC1C; identical to SEQ ID NO: 7841

SEQ ID NO: 10914 - protein, 760 aa, Escherichia coli DEC1C; identical to SEQ ID NO: 10799

SEQ ID NO: 10915 - protein, 203 aa, Escherichia coli DEC1C; identical to SEQ ID NO: 6414

SEQ ID NO: 10916 - protein, 355 aa, Escherichia coli DEC1C
MKRNILAVVVSALLVAGTANAAEIYNKDGNKLDLYGKAVGLHYFSKGNGENSYGGNGDKTYARLGFKGETQINSDLTGYGQWEYNFQGNNSEGDDAQNGNKTRLAFAGLKFADAGSFDYGRNYGVVYDALGYTDMLPEFGGDTAYSDDFFVGRVGGVATYRNSNFFGLVDGLNFAVQYLGKNERDTARRSNGDGVGGSVSYEFEGFGIVGAYGAADRTNLQEDSTLGKGKKAEQWATGLKYDANNIYLAANYGETRNATPITGGFANKTQDILLVAQYQFDFGLRPSIAYTKSKAKDVEGIGDVDLVNYIEVGATYYFNKNMSTYVDYAINQIDSDNKLGVGSDDTVAVGIVYQF

SEQ ID NO: 10917 - protein, 191 aa, Escherichia coli DEC1C; identical to SEQ ID NO: 5748

SEQ ID NO: 10918 - protein, 232 aa, Escherichia coli DEC1C; identical to SEQ ID NO: 5747

SEQ ID NO: 10919 - protein, 729 aa, Escherichia coli DEC1C; identical to SEQ ID NO: 7833

SEQ ID NO: 10920 - protein, 213 aa, Escherichia coli DEC1C; identical to SEQ ID NO: 5744

SEQ ID NO: 10921 - protein, 203 aa, Escherichia coli DEC1C; identical to SEQ ID NO: 7809

SEQ ID NO: 10922 - protein, 656 aa, Escherichia coli DEC1C; identical to SEQ ID NO: 7810

SEQ ID NO: 10923 - protein, 565 aa, Escherichia coli DEC1C; identical to SEQ ID NO: 7811

SEQ ID NO: 10924 - protein, 207 aa, Escherichia coli DEC1C; identical to SEQ ID NO: 7812

SEQ ID NO: 10925 - protein, 407 aa, Escherichia coli DEC1C; identical to SEQ ID NO: 10865

SEQ ID NO: 10926 - protein, 388 aa, Escherichia coli DEC1C
MTVKISGVLKDGTGKPVQNCTIVLKARRTSSTVVVNTVASENPDEAGRYSMDVEHGQYSVTLLVEGFPPSHAGTITVYEGSRPGTLNDFLGAMTEDDVRPEALRRFELMVEEAARHAEEAKKNAGEAETSARNAGISASQAEESAANADTSAGDASESARQAAESAAAAKQSEEASSSSASAAAQKASESSQSAADAELSKKTAESAAGNAARDATTATEKARESAESAQSAEQSRIAAEEAVNRIPTVVGPPGPKGEPGPAGPQGPKGDKGERGDTGPAGATGERGPAGDAGPAGPQGPKGDRGERGETGLTGNAGPQGPKGDTGAAGPAGPQEKQVRLARWGQPDLRDRRATRGRHKSVFVWGRRALLRQTAMAGSRIQMAHSSPD

SEQ ID NO: 10927 - protein, 551 aa, Escherichia coli DEC1C; identical to SEQ ID NO: 7843

SEQ ID NO: 10928 - protein, 700 aa, Escherichia coli DEC1C; identical to SEQ ID NO: 10811

SEQ ID NO: 10929 - protein, 236 aa, Escherichia coli DEC1C; identical to SEQ ID NO: 7814

SEQ ID NO: 10930 - protein, 111 aa, Escherichia coli DEC1C; identical to SEQ ID NO: 10814

SEQ ID NO: 10931 - protein, 118 aa, Escherichia coli DEC1C [sequence omitted]

SEQ ID NO: 10932 - protein, 826 aa, Escherichia coli DEC1C; identical to SEQ ID NO: 7836

SEQ ID NO: 10933 - protein, 165 aa, Escherichia coli DEC1C; identical to SEQ ID NO: 7837

SEQ ID NO: 10934 - protein, 641 aa, Escherichia coli DEC1C; identical to SEQ ID NO: 7819

SEQ ID NO: 10935 - protein, 162 aa, Escherichia coli DEC1C; identical to SEQ ID NO: 5896

SEQ ID NO: 10936 - protein, 371 aa, Escherichia coli DEC1C; identical to SEQ ID NO: 7822

SEQ ID NO: 10937 - protein, 200 aa, Escherichia coli DEC1C; identical to SEQ ID NO: 5898

SEQ ID NO: 10938 - protein, 274 aa, Escherichia coli DEC1C; identical to SEQ ID NO: 5899

SEQ ID NO: 10939 - protein, 249 aa, Escherichia coli DEC1C; identical to SEQ ID NO: 7817

SEQ ID NO: 10940 - protein, 879 aa, Escherichia coli DEC1C; identical to SEQ ID NO: 7818

SEQ ID NO: 10941 - protein, 518 aa, Escherichia coli DEC1C; identical to SEQ ID NO: 7565

SEQ ID NO: 10942 - protein, 432 aa, Escherichia coli DEC1C; identical to SEQ ID NO: 5727

SEQ ID NO: 10943 - protein, 359 aa, Escherichia coli DEC1C; identical to SEQ ID NO: 5847

SEQ ID NO: 10944 - protein, 686 aa, Escherichia coli DEC1C; identical to SEQ ID NO: 7831

SEQ ID NO: 10945 - protein, 711 aa, Escherichia coli DEC1C; identical to SEQ ID NO: 8259

SEQ ID NO: 10946 - protein, 678 aa, Escherichia coli DEC1C; identical to SEQ ID NO: 7829

SEQ ID NO: 10947 - protein, 386 aa, Escherichia coli DEC1C; identical to SEQ ID NO: 7828

SEQ ID NO: 10948 - protein, 660 aa, Escherichia coli DEC1C
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFSVFGTGGTGDHSLGLGASAFGRTENLDGIVAWPSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 10949 - protein, 859 aa, Escherichia coli DEC1C; identical to SEQ ID NO: 10831

SEQ ID NO: 10950 - protein, 199 aa, Escherichia coli DEC1C; identical to SEQ ID NO: 7825

SEQ ID NO: 10951 - protein, 512 aa, Escherichia coli DEC1C; identical to SEQ ID NO: 6120

SEQ ID NO: 10952 - protein, 208 aa, Escherichia coli DEC1C; identical to SEQ ID NO: 5869

SEQ ID NO: 10953 - protein, 446 aa, Escherichia coli DEC1C; identical to SEQ ID NO: 5873

SEQ ID NO: 10954 - protein, 237 aa, Escherichia coli DEC1C; identical to SEQ ID NO: 7546

SEQ ID NO: 10955 - protein, 478 aa, Escherichia coli DEC1C; identical to SEQ ID NO: 6796

SEQ ID NO: 10956 - protein, 368 aa, Escherichia coli DEC1C; identical to SEQ ID NO: 7797

SEQ ID NO: 10957 - protein, 241 aa, Escherichia coli DEC1C; identical to SEQ ID NO: 6140

SEQ ID NO: 10958 - protein, 856 aa, Escherichia coli DEC1C; identical to SEQ ID NO: 7799

SEQ ID NO: 10959 - protein, 237 aa, Escherichia coli DEC1D; identical to SEQ ID NO: 7546

SEQ ID NO: 10960 - protein, 774 aa, Escherichia coli DEC1D
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDCFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 10961 - protein, 170 aa, Escherichia coli DEC1D; identical to SEQ ID NO: 7801

SEQ ID NO: 10962 - protein, 765 aa, Escherichia coli DEC1D
MQFHISSPDKNSGKAILLKRDDDLGDCLNLAEMISQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLDTDHRSSGFQSIDTQLNSDFKGNNQLNISSSGYSDTNRISYSVNTGYMMNKSSDDLSYIGGHASYESPWGTLSGSASASSDNSRQFSLNTDGGFVLHSGGLTFSNDSFSDSDTLAVIQAPGAKGARINYGNSTVDRWSYGVTSALSPYHENRIALDINDLENDVELKSTSTVAIPRQGAVVFADFETVQGQSAIMNIVRSDGKNIPFAEDIYDEQNNIIGNVGQGGQAFVHGIEQEENIRITWIEEGKPVSCFAHYQQNTASEKIAQSIILNGLRCQIQ

SEQ ID NO: 10963 - protein, 200 aa, Escherichia coli DEC1D; identical to SEQ ID NO: 7803

SEQ ID NO: 10964 - protein, 238 aa, Escherichia coli DEC1D; identical to SEQ ID NO: 7804

SEQ ID NO: 10965 - protein, 731 aa, Escherichia coli DEC1D
MARSKTAQPKHSLRKIAVVVATAVSGMSVYAQAAVEPKEDTITVTAAPAPQESAWGPAATIAAKHSATATKTDTPIEKTPQSISVVTREEMDIKQPATVKEALDYTPSVFSTRGSSTTYDVVSIRGFTTASTVNTNQYLDGLKLQGDNYSEASIDPYFLERVELLRGPVSVLYGKSHPGGVVSMVSKRPSTDPIKEIQFKMGTDNLWQTGFDFSDAIDDDGVWSYRLTGLGRSQDAQQKYAKTTRYAVAPSFSWRPDDKTDFTFLSNFQSDPDAGYYGWLPRQGTVVPYQDANGSWHKLPTDFNEGEKDNKMSRRQQLIGYSFAHEFNDTFTVRQNLRYTRIHTLYDAVYGNGYIAPAQISRAYVRSDEDLNSFTVDTQLQSNFAIGAVAHTLLTGVDYLRMRNDIDANYGTANPISMTDPQYGNANININFPYAVINRQEQTGLYIQDQSEWNKWVLTLGGRYDFAKTSTYTRSTSSLDEINDQQFTWRGGINYLFDNGISPYFSYSESFEPVSGATKEGKPFDPSRGKQYEAGVKYVPKDTPVTVTASVFQLTKDKNLTADPSNTLFSVQGGEIRSRGFEIEAKAAVNANINVTAAYSYTDAEYTKDTLYKGKRPAEVPRNMASLWADYTFHETALSGLSLGAGARYFGDTSSFYTTGDKTNQTFNVGGYTLVDAMIKYDLARFGMPGSSVGVNVNNLFDREYVSSCYRDYACYWGAERQVVATATFRF

SEQ ID NO: 10966 - protein, 266 aa, Escherichia coli DEC1D; identical to SEQ ID NO: 7806

SEQ ID NO: 10967 - protein, 161 aa, Escherichia coli DEC1D; identical to SEQ ID NO: 5769

SEQ ID NO: 10968 - protein, 351 aa, Escherichia coli DEC1D; identical to SEQ ID NO: 7789

SEQ ID NO: 10969 - protein, 430 aa, Escherichia coli DEC1D; identical to SEQ ID NO: 5758

SEQ ID NO: 10970 - protein, 746 aa, Escherichia coli DEC1D; identical to SEQ ID NO: 7788

SEQ ID NO: 10971 - protein, 193 aa, Escherichia coli DEC1D; identical to SEQ ID NO: 6300

SEQ ID NO: 10972 - protein, 331 aa, Escherichia coli DEC1D; identical to SEQ ID NO: 6551

SEQ ID NO: 10973 - protein, 760 aa, Escherichia coli DEC1D
MENNRNFPARQFHSLTFFAGLCIGITPVAQALAAEGQANADDTLVVEASTPSLYAPQKSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRNKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 10974 - protein, 203 aa, Escherichia coli DEC1D; identical to SEQ ID NO: 6414

SEQ ID NO: 10975 - protein, 355 aa, Escherichia coli DEC1D; identical to SEQ ID NO: 7838

SEQ ID NO: 10976 - protein, 191 aa, Escherichia coli DEC1D; identical to SEQ ID NO: 5748

SEQ ID NO: 10977 - protein, 232 aa, Escherichia coli DEC1D; identical to SEQ ID NO: 5747

SEQ ID NO: 10978 - protein, 729 aa, Escherichia coli DEC1D; identical to SEQ ID NO: 7833

SEQ ID NO: 10979 - protein, 213 aa, Escherichia coli DEC1D; identical to SEQ ID NO: 5744

SEQ ID NO: 10980 - protein, 203 aa, Escherichia coli DEC1D; identical to SEQ ID NO: 7809

SEQ ID NO: 10981 - protein, 656 aa, Escherichia coli DEC1D; identical to SEQ ID NO: 7810

SEQ ID NO: 10982 - protein, 565 aa, Escherichia coli DEC1D; identical to SEQ ID NO: 7811

SEQ ID NO: 10983 - protein, 207 aa, Escherichia coli DEC1D; identical to SEQ ID NO: 7812

SEQ ID NO: 10984 - protein, 551 aa, Escherichia coli DEC1D; identical to SEQ ID NO: 7843

SEQ ID NO: 10985 - protein, 646 aa, Escherichia coli DEC1D; identical to SEQ ID NO: 7842

SEQ ID NO: 10986 - protein, 871 aa, Escherichia coli DEC1D; identical to SEQ ID NO: 10869

SEQ ID NO: 10987 - protein, 224 aa, Escherichia coli DEC1D
MATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 10988 - protein, 407 aa, Escherichia coli DEC1D; identical to SEQ ID NO: 10865

SEQ ID NO: 10989 - protein, 111 aa, Escherichia coli DEC1D; identical to SEQ ID NO: 10814

SEQ ID NO: 10990 - protein, 118 aa, Escherichia coli DEC1D [sequence omitted]

SEQ ID NO: 10991 - protein, 826 aa, Escherichia coli DEC1D; identical to SEQ ID NO: 7836

SEQ ID NO: 10992 - protein, 165 aa, Escherichia coli DEC1D; identical to SEQ ID NO: 7837

SEQ ID NO: 10993 - protein, 641 aa, Escherichia coli DEC1D; identical to SEQ ID NO: 7819

SEQ ID NO: 10994 - protein, 162 aa, Escherichia coli DEC1D; identical to SEQ ID NO: 5896

SEQ ID NO: 10995 - protein, 371 aa, Escherichia coli DEC1D; identical to SEQ ID NO: 7822

SEQ ID NO: 10996 - protein, 200 aa, Escherichia coli DEC1D; identical to SEQ ID NO: 5898

SEQ ID NO: 10997 - protein, 274 aa, Escherichia coli DEC1D; identical to SEQ ID NO: 5899

SEQ ID NO: 10998 - protein, 249 aa, Escherichia coli DEC1D; identical to SEQ ID NO: 7817

SEQ ID NO: 10999 - protein, 879 aa, Escherichia coli DEC1D; identical to SEQ ID NO: 7818

SEQ ID NO: 11000 - protein, 518 aa, Escherichia coli DEC1D; identical to SEQ ID NO: 7565

SEQ ID NO: 11001 - protein, 359 aa, Escherichia coli DEC1D; identical to SEQ ID NO: 5847

SEQ ID NO: 11002 - protein, 432 aa, Escherichia coli DEC1D; identical to SEQ ID NO: 5727

SEQ ID NO: 11003 - protein, 711 aa, Escherichia coli DEC1D; identical to SEQ ID NO: 8259

SEQ ID NO: 11004 - protein, 686 aa, Escherichia coli DEC1D; identical to SEQ ID NO: 7831

SEQ ID NO: 11005 - protein, 678 aa, Escherichia coli DEC1D; identical to SEQ ID NO: 7829

SEQ ID NO: 11006 - protein, 412 aa, Escherichia coli DEC1D
MKQWIAALLLMLIPGVQAAKPQKVTLMVDDVPVAQVLQALAEQEKLNLVVSPDVSGTVSLHLTDVPWKQALQTVVKSAGLITRQEGNILSVHSVAWQNDNIARQEAEQTRAQANLPLENRNITLQYADAGELAKAGEKLLSAKGSMTVDKRTNRLLLRDNKTALSTLEQWVSQMDLPVGQVELSAHIVTINEKSLRELGVKWTLADAQQAGGVGQVTTLGSDLSVATATTHIGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 11007 - protein, 660 aa, Escherichia coli DEC1D; identical to SEQ ID NO: 10888

SEQ ID NO: 11008 - protein, 857 aa, Escherichia coli DEC1D
MDGRFAHLHFFFPFSLSVLALTVAGSFSATAGKFNPRFLEDTAGINQHVDLSMYETDHGAQLPGTYRVSLIVNEQKMETRTLEFKAATESQRKEMGEFLIPCLSRTQLADMGVRVDSFSALNLIPAEACVAFNEIIPQATSHFDFSEQKLVMSFPQAAMQQVARGTVPESRWDDGVPALLLDYSFSGSNSSHDTKSYNRYIDENGNHHQDKNETSQTNDSYYLSMRSGLNLGAWRLRNYSNWSYSNGEKQWDNIGTYVTRAIVPLKAQLTLGDTATPSDIFDSVQMRGALLASDEEMLPDSQRGFAPVVRGIAKSNAEVSIEQNGYVIYRAFVQPGAFEINDLYPTANSGDLTVIVKEADGSEQRFIQPFSSVAVFQREGHLKYSLSAGEYRAGNYDSANPRFGQFNAMYGLPFGMTTYGGALISKDYNAFALGLGKNFGSIGAISVDITQAKSTLNNNATDQGQSYRFLYSKSFASGTDFRLLGYKYSTSGFYTFQEATDVRSGADSDYGRYHKRSEIQGNLTQQLGTYGSVYFNMTQQDYWNDDGKRLSLATGYNGRIGRVNYSIAYSWNKSPEWDENDQLWSFNISIPFGRAWSNYRVTTDQDGRTIQQLGVNGTLLEDRNLSYNVQEGYSSNGVGNSGNASLAYQGGAGNISVGYSYGKDYQQTNYSLRGGIVAHSEGISLSQPLGETIAIVSAPGARGAKVLNNSGVSVDWQGNAVVPYLSIYRENDVSIRSETLNDSVDMNSAFQTIVPTRGAVVRAHFDTRVGYRVLMTLIRQNGVSVPFGATATLVSDTTEQISGIVGEDGQLYISGMPKTGNVKIVWGKDTSQQCVAKYELPVEEKNSGIISVTANCQ

SEQ ID NO: 11009 - protein, 512 aa, Escherichia coli DEC1D; identical to SEQ ID NO: 6120

SEQ ID NO: 11010 - protein, 208 aa, Escherichia coli DEC1D; identical to SEQ ID NO: 5869

SEQ ID NO: 11011 - protein, 446 aa, Escherichia coli DEC1D; identical to SEQ ID NO: 5873

SEQ ID NO: 11012 - protein, 774 aa, Escherichia coli DEC1E; identical to SEQ ID NO: 6673

SEQ ID NO: 11013 - protein, 368 aa, Escherichia coli DEC1E; identical to SEQ ID NO: 7797

SEQ ID NO: 11014 - protein, 241 aa, Escherichia coli DEC1E; identical to SEQ ID NO: 6140

SEQ ID NO: 11015 - protein, 863 aa, Escherichia coli DEC1E
MHIRKHRLAGFFVRLFVACAFAAQAPLSSAELYFNPRFLADDPQAVADLSRFENGQELPPGTYRVDIYLNNGYMATRDVSFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLCDNTTWSYNSSDSSSGSKNKWQHINTWLERDIIPLRSRLTLGDGYTQGDIFDGINFRGAQLASDDNMLPDSQRGFAPVIHGIAHGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGIYGTLLEDNDLSYSVQTGYAGGGDGNSGSTGYATLNYRGGYGNANIGYSHSDDIKRLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSVECR

SEQ ID NO: 11016 - protein, 784 aa, Escherichia coli DEC1E; identical to SEQ ID NO: 7800

SEQ ID NO: 11017 - protein, 170 aa, Escherichia coli DEC1E; identical to SEQ ID NO: 7801

SEQ ID NO: 11018 - protein, 790 aa, Escherichia coli DEC1E; identical to SEQ ID NO: 7802

SEQ ID NO: 11019 - protein, 200 aa, Escherichia coli DEC1E; identical to SEQ ID NO: 7803

SEQ ID NO: 11020 - protein, 221 aa, Escherichia coli DEC1E
MQVQASVVLGGTRIIYPSNQNEVQITLKNKDAYARYLVQSWVSNIDGSKAPFLITPPVYKLEENRQTLLHIVFTGDKDKLPQDRESLFLANVKSVSAMPEELKDKNILQFAMKARLKLFWRPVSLDNNDALTAWEKLKFHKEAGKLIVKNPTPFYILFNDLTVSGKNIVPVDTKSEPGALLMMVGPFSEQRFSLPAGAGNVVEWSVITDYGSSSGKRKQKL

SEQ ID NO: 11021 - protein, 731 aa, Escherichia coli DEC1E; identical to SEQ ID NO: 7805

SEQ ID NO: 11022 - protein, 266 aa, Escherichia coli DEC1E; identical to SEQ ID NO: 7806

SEQ ID NO: 11023 - protein, 161 aa, Escherichia coli DEC1E; identical to SEQ ID NO: 5769

SEQ ID NO: 11024 - protein, 351 aa, Escherichia coli DEC1E; identical to SEQ ID NO: 7789

SEQ ID NO: 11025 - protein, 746 aa, Escherichia coli DEC1E; identical to SEQ ID NO: 7788

SEQ ID NO: 11026 - protein, 193 aa, Escherichia coli DEC1E; identical to SEQ ID NO: 6300

SEQ ID NO: 11027 - protein, 430 aa, Escherichia coli DEC1E; identical to SEQ ID NO: 5758

SEQ ID NO: 11028 - protein, 331 aa, Escherichia coli DEC1E; identical to SEQ ID NO: 7841

SEQ ID NO: 11029 - protein, 760 aa, Escherichia coli DEC1E; identical to SEQ ID NO: 10799

SEQ ID NO: 11030 - protein, 203 aa, Escherichia coli DEC1E; identical to SEQ ID NO: 6414

SEQ ID NO: 11031 - protein, 355 aa, Escherichia coli DEC1E; identical to SEQ ID NO: 7838

SEQ ID NO: 11032 - protein, 517 aa, Escherichia coli DEC1E; identical to SEQ ID NO: 6817

SEQ ID NO: 11033 - protein, 191 aa, Escherichia coli DEC1E; identical to SEQ ID NO: 5748

SEQ ID NO: 11034 - protein, 232 aa, Escherichia coli DEC1E; identical to SEQ ID NO: 5747

SEQ ID NO: 11035 - protein, 729 aa, Escherichia coli DEC1E
MLSTQFNRDNQHQTTSKPSLLAACIALALLPSAAFAAPATEETVIVEGSATTPVDDENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSGNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQKDRDSSGKYLAPITGNNYELGLKSDWMNSRLTTTLAIFRIEQDNVAQSTGTPIPGSNGETAYKAVDGTVSKRVEFELNGAITDNWQLTFGATRYIAEDNEGNAVNPNLPRTTIKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 11036 - protein, 213 aa, Escherichia coli DEC1E; identical to SEQ ID NO: 5744

SEQ ID NO: 11037 - protein, 656 aa, Escherichia coli DEC1E; identical to SEQ ID NO: 7810

SEQ ID NO: 11038 - protein, 565 aa, Escherichia coli DEC1E; identical to SEQ ID NO: 7811

SEQ ID NO: 11039 - protein, 207 aa, Escherichia coli DEC1E; identical to SEQ ID NO: 7812

SEQ ID NO: 11040 - protein, 539 aa, Escherichia coli DEC1E
MAAVCGTSGIASLFSQAAFAADSDIADGQTQRFDLSILQSMAHDLAQTAWRGAPRQLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKNQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 11041 - protein, 672 aa, Escherichia coli DEC1E
MIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDFDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTLSTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTIYKNAGKTRRQGAELAWDQRFAGDFRVKASWTWLDATYRSNVCNEQDCNGNRMPGIARNMAFASIGYIPEDGWYAGTEARYMGDIMADDENTAKAPSYTLVGLFTGYKYNYHNLTVDLFGRVDNLFDKEYVGSVIVNESNGRYYEPAPGRNYGVGINIAWRFE

SEQ ID NO: 11042 - protein, 871 aa, Escherichia coli DEC1E; identical to SEQ ID NO: 10869

SEQ ID NO: 11043 - protein, 236 aa, Escherichia coli DEC1E; identical to SEQ ID NO: 7814

SEQ ID NO: 11044 - protein, 111 aa, Escherichia coli DEC1E; identical to SEQ ID NO: 10814

SEQ ID NO: 11045 - protein, 118 aa, Escherichia coli DEC1E [sequence omitted]

SEQ ID NO: 11046 - protein, 826 aa, Escherichia coli DEC1E; identical to SEQ ID NO: 7836

SEQ ID NO: 11047 - protein, 165 aa, Escherichia coli DEC1E; identical to SEQ ID NO: 7837

SEQ ID NO: 11048 - protein, 641 aa, Escherichia coli DEC1E; identical to SEQ ID NO: 7819

SEQ ID NO: 11049 - protein, 162 aa, Escherichia coli DEC1E; identical to SEQ ID NO: 5896

SEQ ID NO: 11050 - protein, 371 aa, Escherichia coli DEC1E; identical to SEQ ID NO: 7822

SEQ ID NO: 11051 - protein, 200 aa, Escherichia coli DEC1E; identical to SEQ ID NO: 5898

SEQ ID NO: 11052 - protein, 274 aa, Escherichia coli DEC1E; identical to SEQ ID NO: 5899

SEQ ID NO: 11053 - protein, 249 aa, Escherichia coli DEC1E; identical to SEQ ID NO: 7817

SEQ ID NO: 11054 - protein, 879 aa, Escherichia coli DEC1E; identical to SEQ ID NO: 7818

SEQ ID NO: 11055 - protein, 472 aa, Escherichia coli DEC1E; identical to SEQ ID NO: 7376

SEQ ID NO: 11056 - protein, 432 aa, Escherichia coli DEC1E; identical to SEQ ID NO: 5727

SEQ ID NO: 11057 - protein, 359 aa, Escherichia coli DEC1E; identical to SEQ ID NO: 5847

SEQ ID NO: 11058 - protein, 615 aa, Escherichia coli DEC1E
MFWRDMTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKNVT

SEQ ID NO: 11059 - protein, 713 aa, Escherichia coli DEC1E
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 11060 - protein, 678 aa, Escherichia coli DEC1E; identical to SEQ ID NO: 7829

SEQ ID NO: 11061 - protein, 386 aa, Escherichia coli DEC1E; identical to SEQ ID NO: 8261

SEQ ID NO: 11062 - protein, 512 aa, Escherichia coli DEC1E; identical to SEQ ID NO: 6120

SEQ ID NO: 11063 - protein, 660 aa, Escherichia coli DEC1E; identical to SEQ ID NO: 10888

SEQ ID NO: 11064 - protein, 859 aa, Escherichia coli DEC1E; identical to SEQ ID NO: 10831

SEQ ID NO: 11065 - protein, 199 aa, Escherichia coli DEC1E; identical to SEQ ID NO: 7825

SEQ ID NO: 11066 - protein, 208 aa, Escherichia coli DEC1E; identical to SEQ ID NO: 5869

SEQ ID NO: 11067 - protein, 317 aa, Escherichia coli DEC1E
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMY

SEQ ID NO: 11068 - protein, 102 aa, Escherichia coli DEC1E
MSTVMEIGYDNVESQRTGDKNNQYKITLAQQWQAGDSIWSRPAIRVFATYAKWDEKWGYDYTGSSSTNPYYGKAVSADFNGGSFGRGDSDEWTFGAQMEIWW

SEQ ID NO: 11069 - protein, 373 aa, Escherichia coli DEC1E
MAVKISGVLKDGTGKPVQNCTIQLKAKRNSTTVVVNTLASENPDEAGRYSMDVEYGQYSVILLVEGFPPSHAGTITVYEDSQPGTLNDFLGAMTEDDARPEALRRFELMVEEAARHAEEAKKNAGEAETSARNAGISAGQAEKSAVNAETSAGDASESARQATESAASAKQSEDASSSSASAAAQKASESSQSAAEAELSRKTAESAAGNASRDATTAAEKARESAESAQSAEQSRIAAEDAVNRIPTVVGPPGPKGEPGPAGPQGPKGDKGERGDTGPVGATGERGPAGDAGPAGPQGPKGDRGERGETGLTGNAGPQGPKGDTGAAGPDRPTGTERRNRCGWPGGGNRTSGTKGRPGGDTNPFSSGAGEHY

SEQ ID NO: 11070 - protein, 237 aa, Escherichia coli DEC1E; identical to SEQ ID NO: 7546

SEQ ID NO: 11071 - protein, 478 aa, Escherichia coli DEC1E; identical to SEQ ID NO: 6796

SEQ ID NO: 11072 - protein, 361 aa, Escherichia coli DEC2A
MTVKISGVLKDGTGKPVQNCTIVLKARRTSSTVVVNTVASENPDEAGRYSMDVEHGQYSVTLLVEGFPPSHAGTITVYEGSRPGTLNDFLGAMTEDDVRPEALRRFELMVEEAARHAEEAKKNAGEAETSARNAGISASQAEESAANADTSAGDASESARQAAESAAAAKQSEEASSSSASAAAQKASESSQSAADAELSKKTAESAAGNAARDATTATEKARESAESAQSAEQSRIAAEEAVNRIPTVVGPPGPKGEPGPAGPQGPKGDKGERGDTGPAGATGERGPAGDAGPAGPQGPKGDRGERGETGLTGNAGPQGPKGDTGAAGPAGPQGPKGETGAAGPVGATGPQGPKGDPGET

SEQ ID NO: 11073 - protein, 774 aa, Escherichia coli DEC2A; identical to SEQ ID NO: 6673

SEQ ID NO: 11074 - protein, 368 aa, Escherichia coli DEC2A; identical to SEQ ID NO: 7797

SEQ ID NO: 11075 - protein, 241 aa, Escherichia coli DEC2A; identical to SEQ ID NO: 6140

SEQ ID NO: 11076 - protein, 856 aa, Escherichia coli DEC2A; identical to SEQ ID NO: 7799

SEQ ID NO: 11077 - protein, 170 aa, Escherichia coli DEC2A; identical to SEQ ID NO: 7801

SEQ ID NO: 11078 - protein, 862 aa, Escherichia coli DEC2A
MTIKSTNHLTHIATFCALLYSNSALCAELVEYDHTFLMGNDASNIDLSRYTEGNPTLPGIYDVSVYINDQPIMSQSIAFTVIEGKKNAQACITQKNLLQFHISSPDKNSGKAILLKRDDDLGDCLNLAEMISQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLDTDHRSSGFQSIDTQLNSDFKGNNQLNISSSGYSDTNRISYSVNTGYMMNKSSDDLSYIGGHASYESPWGTLSGSASASSDNSRQFSLNTDGGFVLHSGGLTFSNDSFSDSDTLAVIQAPGAKGARINYGNSTVDRWSYGVTSALSPYHENRIALDINDLENDVELKSTSTVAIPRQGAVVFADFETVQGQSAIMNIVRSDGKNIPFAEDIYDEQNNIIGNVGQGGQAFVHGIEQEENIRITWIEEGKPVSCFAHYQQNTASEKIAQSIILNGLRCQIQ

SEQ ID NO: 11079 - protein, 200 aa, Escherichia coli DEC2A; identical to SEQ ID NO: 7803

SEQ ID NO: 11080 - protein, 731 aa, Escherichia coli DEC2A; identical to SEQ ID NO: 7805

SEQ ID NO: 11081 - protein, 266 aa, Escherichia coli DEC2A; identical to SEQ ID NO: 7806

SEQ ID NO: 11082 - protein, 161 aa, Escherichia coli DEC2A; identical to SEQ ID NO: 5769

SEQ ID NO: 11083 - protein, 351 aa, Escherichia coli DEC2A; identical to SEQ ID NO: 7789

SEQ ID NO: 11084 - protein, 746 aa, Escherichia coli DEC2A; identical to SEQ ID NO: 7788

SEQ ID NO: 11085 - protein, 193 aa, Escherichia coli DEC2A; identical to SEQ ID NO: 6300

SEQ ID NO: 11086 - protein, 430 aa, Escherichia coli DEC2A; identical to SEQ ID NO: 5758

SEQ ID NO: 11087 - protein, 331 aa, Escherichia coli DEC2A; identical to SEQ ID NO: 7841

SEQ ID NO: 11088 - protein, 641 aa, Escherichia coli DEC2A
MRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRNKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 11089 - protein, 203 aa, Escherichia coli DEC2A; identical to SEQ ID NO: 6414

SEQ ID NO: 11090 - protein, 355 aa, Escherichia coli DEC2A; identical to SEQ ID NO: 7838

SEQ ID NO: 11091 - protein, 826 aa, Escherichia coli DEC2A; identical to SEQ ID NO: 7836

SEQ ID NO: 11092 - protein, 165 aa, Escherichia coli DEC2A; identical to SEQ ID NO: 7837

SEQ ID NO: 11093 - protein, 191 aa, Escherichia coli DEC2A; identical to SEQ ID NO: 5748

SEQ ID NO: 11094 - protein, 232 aa, Escherichia coli DEC2A; identical to SEQ ID NO: 5747

SEQ ID NO: 11095 - protein, 729 aa, Escherichia coli DEC2A; identical to SEQ ID NO: 7833

SEQ ID NO: 11096 - protein, 213 aa, Escherichia coli DEC2A; identical to SEQ ID NO: 5744

SEQ ID NO: 11097 - protein, 203 aa, Escherichia coli DEC2A; identical to SEQ ID NO: 7809

SEQ ID NO: 11098 - protein, 656 aa, Escherichia coli DEC2A
MRLKKRYLCTALSLAFTQQAVAAQESDTLTVWSSPVSSTTTTVLDQPTMKAQDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAVSSDLGYLQVSGSQLKQDFLGLPHGVNNDIAGKHGKMINSSADDKRGIVKLGFTPRENDEYTLTYIKQDGEKDNPPYSRNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKINDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 11099 - protein, 565 aa, Escherichia coli DEC2A; identical to SEQ ID NO: 7811

SEQ ID NO: 11100 - protein, 207 aa, Escherichia coli DEC2A; identical to SEQ ID NO: 7812

SEQ ID NO: 11101 - protein, 539 aa, Escherichia coli DEC2A; identical to SEQ ID NO: 10810

SEQ ID NO: 11102 - protein, 700 aa, Escherichia coli DEC2A; identical to SEQ ID NO: 10811

SEQ ID NO: 11103 - protein, 871 aa, Escherichia coli DEC2A; identical to SEQ ID NO: 10869

SEQ ID NO: 11104 - protein, 236 aa, Escherichia coli DEC2A; identical to SEQ ID NO: 7814

SEQ ID NO: 11105 - protein, 407 aa, Escherichia coli DEC2A; identical to SEQ ID NO: 10865

SEQ ID NO: 11106 - protein, 111 aa, Escherichia coli DEC2A; identical to SEQ ID NO: 10814

SEQ ID NO: 11107 - protein, 118 aa, Escherichia coli DEC2A [sequence omitted]

SEQ ID NO: 11108 - protein, 162 aa, Escherichia coli DEC2A; identical to SEQ ID NO: 5896

SEQ ID NO: 11109 - protein, 371 aa, Escherichia coli DEC2A; identical to SEQ ID NO: 7822

SEQ ID NO: 11110 - protein, 200 aa, Escherichia coli DEC2A; identical to SEQ ID NO: 5898

SEQ ID NO: 11111 - protein, 274 aa, Escherichia coli DEC2A
MNKTAIALLALLASSASLAATPWQKITQPVPGSAQSIGSFSNGCIVGADTLPIQSEHYQVMHTDQRRYFGHPDLVMFIQRLSRQVSNLGMGTVLIGDMGMPAGGRFNGGHASHQTGLDVDIFLQLPKTRWTSAQLLRPQALDLVSRDGKHVVPALWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 11112 - protein, 249 aa, Escherichia coli DEC2A; identical to SEQ ID NO: 7817

SEQ ID NO: 11113 - protein, 879 aa, Escherichia coli DEC2A; identical to SEQ ID NO: 7818

SEQ ID NO: 11114 - protein, 518 aa, Escherichia coli DEC2A; identical to SEQ ID NO: 7565

SEQ ID NO: 11115 - protein, 641 aa, Escherichia coli DEC2A; identical to SEQ ID NO: 7819

SEQ ID NO: 11116 - protein, 432 aa, Escherichia coli DEC2A; identical to SEQ ID NO: 5727

SEQ ID NO: 11117 - protein, 359 aa, Escherichia coli DEC2A; identical to SEQ ID NO: 5847

SEQ ID NO: 11118 - protein, 686 aa, Escherichia coli DEC2A; identical to SEQ ID NO: 7831

SEQ ID NO: 11119 - protein, 711 aa, Escherichia coli DEC2A; identical to SEQ ID NO: 8259

SEQ ID NO: 11120 - protein, 678 aa, Escherichia coli DEC2A; identical to SEQ ID NO: 7829

SEQ ID NO: 11121 - protein, 386 aa, Escherichia coli DEC2A; identical to SEQ ID NO: 8261

SEQ ID NO: 11122 - protein, 660 aa, Escherichia coli DEC2A; identical to SEQ ID NO: 10888

SEQ ID NO: 11123 - protein, 859 aa, Escherichia coli DEC2A
MSWMVVSRTYTSFFPFSLSVLALTVAGSFSATAGKFNPRFLEDTAGINQHVDLSMYETDHGAQLPGTYRVSLIVNEQKMETRTLEFKAATESQRKEMGEFLIPCLSRTQLADMGVRVDSFSALNLIPAEACVAFNEIIPQATSHFDFSEQKLVMSFPQAAMQQVARGTVPESRWDDGVPALLLDYSFSGSNSSHDTKSYNRYIDENGNHHQDKNETSQTNDSYYLSMRSGLNLGAWRLRNYSNWSYSNGEKQWDNIGTYVTRAIVPLKAQLTLGDTATPSDIFDSVQMRGALLASDEEMLPDSQRGFAPVVRGIAKSNAEVSIEQNGYVIYRAFVQPGAFEINDLYPTANSGDLTVIVKEADGSEQRFIQPFSSVAVFQREGHLKYSLSAGEYRAGNYDSANPRFGQFNAMYGLPFGMTTYGGALISKDYNAFALGLGKNFGSIGAISVDITQAKSTLNNNATDQGQSYRFLYSKSFASGTDFRLLGYKYSTSGFYTFQEATDVRSGADSDYGRYHKRSEIQGNLTQQLGTYGSVYFNMTQQDYWNDDGKRLSLATGYNGRIGRVNYSIAYSWNKSPEWDENDQLWSFNISIPFGRAWSNYRVTTDQDGRTIQQLGVNGTLLEDRNLSYNVQEGYSSNGVGNSGNASLAYQGGAGNISVGYSYGKDYQQTNYSLRGGIVAHSEGISLSQPLGETIAIVSALGARGAKVLNNSGVSVDWQGNAVVPYLSIYRENDVSIRSETLNDSVDMNSAFQTIVPTRGAVVRAHFDTRVGYRVLMTLIRQNGVSVPFGATATLVSDTTEQISGIVGEDGQLYISGMPKTGNVKIVWGKDTSQQCVAKYELPVEEKNSGIISVTANCQ

SEQ ID NO: 11124 - protein, 138 aa, Escherichia coli DEC2A; identical to SEQ ID NO: 10890

SEQ ID NO: 11125 - protein, 512 aa, Escherichia coli DEC2A; identical to SEQ ID NO: 6120

SEQ ID NO: 11126 - protein, 208 aa, Escherichia coli DEC2A; identical to SEQ ID NO: 5869

SEQ ID NO: 11127 - protein, 446 aa, Escherichia coli DEC2A; identical to SEQ ID NO: 5873

SEQ ID NO: 11128 - protein, 237 aa, Escherichia coli DEC2A; identical to SEQ ID NO: 7546

SEQ ID NO: 11129 - protein, 478 aa, Escherichia coli DEC2A; identical to SEQ ID NO: 6796

SEQ ID NO: 11130 - protein, 170 aa, Escherichia coli DEC2B; identical to SEQ ID NO: 7801

SEQ ID NO: 11131 - protein, 790 aa, Escherichia coli DEC2B; identical to SEQ ID NO: 7802

SEQ ID NO: 11132 - protein, 200 aa, Escherichia coli DEC2B; identical to SEQ ID NO: 7803

SEQ ID NO: 11133 - protein, 221 aa, Escherichia coli DEC2B
MQVQASVVLGGTRIIYPSNQNEVQITLKNKDAYARYLVQSWVSNIDGSKAPFLITPPVYKLEENRQTLLHIVFTGDKDKLPQDRESLFLANVKSVSAMPEELKDKNILQFAMKARLKLFWRPVSLDNNDALTAWEKLKFHKEAGKLIVKNPTPFYISFNDLTVSGKNIVPVDTKSEPGALLMMVGPFSEQRFSLPAGAGNVVEWSVITDYGSSSGKRKQKL

SEQ ID NO: 11134 - protein, 731 aa, Escherichia coli DEC2B; identical to SEQ ID NO: 7805

SEQ ID NO: 11135 - protein, 266 aa, Escherichia coli DEC2B; identical to SEQ ID NO: 7806

SEQ ID NO: 11136 - protein, 161 aa, Escherichia coli DEC2B; identical to SEQ ID NO: 5769

SEQ ID NO: 11137 - protein, 368 aa, Escherichia coli DEC2B; identical to SEQ ID NO: 7797

SEQ ID NO: 11138 - protein, 241 aa, Escherichia coli DEC2B; identical to SEQ ID NO: 6140

SEQ ID NO: 11139 - protein, 856 aa, Escherichia coli DEC2B; identical to SEQ ID NO: 7799

SEQ ID NO: 11140 - protein, 351 aa, Escherichia coli DEC2B; identical to SEQ ID NO: 7789

SEQ ID NO: 11141 - protein, 746 aa, Escherichia coli DEC2B; identical to SEQ ID NO: 7788

SEQ ID NO: 11142 - protein, 193 aa, Escherichia coli DEC2B; identical to SEQ ID NO: 6300

SEQ ID NO: 11143 - protein, 430 aa, Escherichia coli DEC2B; identical to SEQ ID NO: 5758

SEQ ID NO: 11144 - protein, 203 aa, Escherichia coli DEC2B; identical to SEQ ID NO: 6414

SEQ ID NO: 11145 - protein, 355 aa, Escherichia coli DEC2B; identical to SEQ ID NO: 7838

SEQ ID NO: 11146 - protein, 331 aa, Escherichia coli DEC2B; identical to SEQ ID NO: 7841

SEQ ID NO: 11147 - protein, 760 aa, Escherichia coli DEC2B; identical to SEQ ID NO: 10799

SEQ ID NO: 11148 - protein, 191 aa, Escherichia coli DEC2B; identical to SEQ ID NO: 5748

SEQ ID NO: 11149 - protein, 232 aa, Escherichia coli DEC2B; identical to SEQ ID NO: 5747

SEQ ID NO: 11150 - protein, 729 aa, Escherichia coli DEC2B
MLSTQFNRDNQHQTTSKPSLLAACIALALLPSAAFAAPATEETVIVEGSATTPVDDENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSGNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQKDRDSSGKYLAPITGNNYELGLKSDWMNSRLTTTLAIFRIEQDNVAQYTGTPIPGSNGETAYKAVDGTVSKGVEFELNGAITDNWQLTFGATRYIAEDNEGNAVNPNLPRTTIKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 11151 - protein, 213 aa, Escherichia coli DEC2B; identical to SEQ ID NO: 5744

SEQ ID NO: 11152 - protein, 207 aa, Escherichia coli DEC2B; identical to SEQ ID NO: 7812

SEQ ID NO: 11153 - protein, 203 aa, Escherichia coli DEC2B; identical to SEQ ID NO: 7809

SEQ ID NO: 11154 - protein, 270 aa, Escherichia coli DEC2B
MAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKINDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 11155 - protein, 565 aa, Escherichia coli DEC2B; identical to SEQ ID NO: 7811

SEQ ID NO: 11156 - protein, 871 aa, Escherichia coli DEC2B; identical to SEQ ID NO: 10869

SEQ ID NO: 11157 - protein, 236 aa, Escherichia coli DEC2B; identical to SEQ ID NO: 7814

SEQ ID NO: 11158 - protein, 356 aa, Escherichia coli DEC2B
MKLITVFFSFVLLSFFSPAYAVSESEARRVEMSMDNAPLPQVISMVWQRVFNRPYQLSPDIAGDTRLVSFYLSKNQEPRSFFISYLKRLNISVTSMKDGVDYISVIKQTEQKVPDVVFTYRPKYRSVSYLSAMLNSVVSSGAFSNHIQSVDYLSGGVSGITTTDSASTRMSIATDAEVLVYSGPAASVRQIEKILPRIDVPAEQVTVSGYVLEVQTTDRNATGLQIIADLFRNKLGMSVGARLDGGNSFTLNVGGLNAFYSLIKEDSRFNVVSNPRLTVLSGSKSQFTVGQEVPVLDSVSYQGSSGTPVQSVTYRNSGAIFTVTPVVLDGLITLDISQQLSDFCKRQRQALTPARH

SEQ ID NO: 11159 - protein, 539 aa, Escherichia coli DEC2B; identical to SEQ ID NO: 10810

SEQ ID NO: 11160 - protein, 700 aa, Escherichia coli DEC2B; identical to SEQ ID NO: 10811

SEQ ID NO: 11161 - protein, 111 aa, Escherichia coli DEC2B; identical to SEQ ID NO: 10814

SEQ ID NO: 11162 - protein, 118 aa, Escherichia coli DEC2B [sequence omitted]

SEQ ID NO: 11163 - protein, 826 aa, Escherichia coli DEC2B; identical to SEQ ID NO: 7836

SEQ ID NO: 11164 - protein, 165 aa, Escherichia coli DEC2B; identical to SEQ ID NO: 7837

SEQ ID NO: 11165 - protein, 371 aa, Escherichia coli DEC2B; identical to SEQ ID NO: 7822

SEQ ID NO: 11166 - protein, 200 aa, Escherichia coli DEC2B; identical to SEQ ID NO: 5898

SEQ ID NO: 11167 - protein, 274 aa, Escherichia coli DEC2B; identical to SEQ ID NO: 5899

SEQ ID NO: 11168 - protein, 249 aa, Escherichia coli DEC2B; identical to SEQ ID NO: 7817

SEQ ID NO: 11169 - protein, 879 aa, Escherichia coli DEC2B; identical to SEQ ID NO: 7818

SEQ ID NO: 11170 - protein, 641 aa, Escherichia coli DEC2B; identical to SEQ ID NO: 7819

SEQ ID NO: 11171 - protein, 162 aa, Escherichia coli DEC2B; identical to SEQ ID NO: 5896

SEQ ID NO: 11172 - protein, 518 aa, Escherichia coli DEC2B; identical to SEQ ID NO: 7565

SEQ ID NO: 11173 - protein, 359 aa, Escherichia coli DEC2B; identical to SEQ ID NO: 5847

SEQ ID NO: 11174 - protein, 432 aa, Escherichia coli DEC2B; identical to SEQ ID NO: 5727

SEQ ID NO: 11175 - protein, 686 aa, Escherichia coli DEC2B; identical to SEQ ID NO: 7831

SEQ ID NO: 11176 - protein, 711 aa, Escherichia coli DEC2B; identical to SEQ ID NO: 8259

SEQ ID NO: 11177 - protein, 678 aa, Escherichia coli DEC2B; identical to SEQ ID NO: 7829

SEQ ID NO: 11178 - protein, 386 aa, Escherichia coli DEC2B; identical to SEQ ID NO: 7828

SEQ ID NO: 11179 - protein, 660 aa, Escherichia coli DEC2B; identical to SEQ ID NO: 10888

SEQ ID NO: 11180 - protein, 859 aa, Escherichia coli DEC2B; identical to SEQ ID NO: 10831

SEQ ID NO: 11181 - protein, 229 aa, Escherichia coli DEC2B
MMKKKFIALTLWVLISQSALASGVGLSSTRVIYDGNKKEASLTVQNKNKSEEFLIQSWVDDATGSKKTPFIITPPLFKLEPGKNNILRIVNVNPSLPQDRESVYWVNVKAIPSQNEENEGKNVLQIAVRTRIKLFYRPAGLKGDIKSSPGELRFTRNGKQIKVDNPTVFNITFSDVFINGHEIEKSGMVPAKGALNIYLPAGVNSASQIKYNTINDFGSSGEYLTREIN

SEQ ID NO: 11182 - protein, 514 aa, Escherichia coli DEC2B; identical to SEQ ID NO: 10891

SEQ ID NO: 11183 - protein, 208 aa, Escherichia coli DEC2B; identical to SEQ ID NO: 5869

SEQ ID NO: 11184 - protein, 446 aa, Escherichia coli DEC2B; identical to SEQ ID NO: 5873

SEQ ID NO: 11185 - protein, 237 aa, Escherichia coli DEC2B; identical to SEQ ID NO: 7546

SEQ ID NO: 11186 - protein, 774 aa, Escherichia coli DEC2B; identical to SEQ ID NO: 6673

SEQ ID NO: 11187 - protein, 731 aa, Escherichia coli DEC2C; identical to SEQ ID NO: 7805

SEQ ID NO: 11188 - protein, 266 aa, Escherichia coli DEC2C; identical to SEQ ID NO: 7806

SEQ ID NO: 11189 - protein, 161 aa, Escherichia coli DEC2C; identical to SEQ ID NO: 5769

SEQ ID NO: 11190 - protein, 170 aa, Escherichia coli DEC2C; identical to SEQ ID NO: 7801

SEQ ID NO: 11191 - protein, 798 aa, Escherichia coli DEC2C; identical to SEQ ID NO: 10841

SEQ ID NO: 11192 - protein, 246 aa, Escherichia coli DEC2C
MFFNTKHTAALCLASCMAFSSSAIADIVISGTQVVYKSEQKSFNVRLENKGNNPLLVQSWLDTGDDNAEPGSITVPFTATPPVSRIDAKRGQTIKLMYTASSALPKDRESVFWFNVLEVPPKPDAAKASNQSLLQLAFRTRIKLFYRPEGLSGMPSDAPLALKWSWATSEGKAALRVDNPTPYYVSFSSGDLEANGKRYPLDMTMIAPFSNDVIKVNGMSGRTSSAKVHFFAINDFGGSIEGNANL

SEQ ID NO: 11193 - protein, 238 aa, Escherichia coli DEC2C; identical to SEQ ID NO: 7804

SEQ ID NO: 11194 - protein, 351 aa, Escherichia coli DEC2C; identical to SEQ ID NO: 7789

SEQ ID NO: 11195 - protein, 746 aa, Escherichia coli DEC2C; identical to SEQ ID NO: 7788

SEQ ID NO: 11196 - protein, 193 aa, Escherichia coli DEC2C; identical to SEQ ID NO: 6300

SEQ ID NO: 11197 - protein, 430 aa, Escherichia coli DEC2C; identical to SEQ ID NO: 5758

SEQ ID NO: 11198 - protein, 331 aa, Escherichia coli DEC2C; identical to SEQ ID NO: 7841

SEQ ID NO: 11199 - protein, 660 aa, Escherichia coli DEC2C; identical to SEQ ID NO: 7840

SEQ ID NO: 11200 - protein, 203 aa, Escherichia coli DEC2C; identical to SEQ ID NO: 6414

SEQ ID NO: 11201 - protein, 355 aa, Escherichia coli DEC2C; identical to SEQ ID NO: 7838

SEQ ID NO: 11202 - protein, 191 aa, Escherichia coli DEC2C; identical to SEQ ID NO: 5748

SEQ ID NO: 11203 - protein, 232 aa, Escherichia coli DEC2C; identical to SEQ ID NO: 5747

SEQ ID NO: 11204 - protein, 729 aa, Escherichia coli DEC2C; identical to SEQ ID NO: 7833

SEQ ID NO: 11205 - protein, 213 aa, Escherichia coli DEC2C; identical to SEQ ID NO: 5744

SEQ ID NO: 11206 - protein, 203 aa, Escherichia coli DEC2C; identical to SEQ ID NO: 7809

SEQ ID NO: 11207 - protein, 656 aa, Escherichia coli DEC2C; identical to SEQ ID NO: 7810

SEQ ID NO: 11208 - protein, 565 aa, Escherichia coli DEC2C; identical to SEQ ID NO: 7811

SEQ ID NO: 11209 - protein, 207 aa, Escherichia coli DEC2C; identical to SEQ ID NO: 7812

SEQ ID NO: 11210 - protein, 407 aa, Escherichia coli DEC2C; identical to SEQ ID NO: 10865

SEQ ID NO: 11211 - protein, 700 aa, Escherichia coli DEC2C; identical to SEQ ID NO: 10811

SEQ ID NO: 11212 - protein, 871 aa, Escherichia coli DEC2C; identical to SEQ ID NO: 10869

SEQ ID NO: 11213 - protein, 236 aa, Escherichia coli DEC2C; identical to SEQ ID NO: 7814

SEQ ID NO: 11214 - protein, 539 aa, Escherichia coli DEC2C; identical to SEQ ID NO: 10810

SEQ ID NO: 11215 - protein, 111 aa, Escherichia coli DEC2C; identical to SEQ ID NO: 10814

SEQ ID NO: 11216 - protein, 130 aa, Escherichia coli DEC2C; identical to SEQ ID NO: 7726

SEQ ID NO: 11217 - protein, 826 aa, Escherichia coli DEC2C; identical to SEQ ID NO: 7836

SEQ ID NO: 11218 - protein, 165 aa, Escherichia coli DEC2C; identical to SEQ ID NO: 7837

SEQ ID NO: 11219 - protein, 641 aa, Escherichia coli DEC2C; identical to SEQ ID NO: 7819

SEQ ID NO: 11220 - protein, 162 aa, Escherichia coli DEC2C; identical to SEQ ID NO: 5896

SEQ ID NO: 11221 - protein, 371 aa, Escherichia coli DEC2C; identical to SEQ ID NO: 7822

SEQ ID NO: 11222 - protein, 196 aa, Escherichia coli DEC2C
MPIFVEVKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRFLQCGNEIYSAIKDLQRKAPDKNIVIFTHNHCLTYIAKDKRDATFKPDYLDGLVMHVEKGKVYLDGEFVNH

SEQ ID NO: 11223 - protein, 274 aa, Escherichia coli DEC2C; identical to SEQ ID NO: 5899

SEQ ID NO: 11224 - protein, 249 aa, Escherichia coli DEC2C; identical to SEQ ID NO: 7817

SEQ ID NO: 11225 - protein, 879 aa, Escherichia coli DEC2C; identical to SEQ ID NO: 7818

SEQ ID NO: 11226 - protein, 472 aa, Escherichia coli DEC2C; identical to SEQ ID NO: 7376

SEQ ID NO: 11227 - protein, 359 aa, Escherichia coli DEC2C; identical to SEQ ID NO: 5847

SEQ ID NO: 11228 - protein, 432 aa, Escherichia coli DEC2C; identical to SEQ ID NO: 5727

SEQ ID NO: 11229 - protein, 613 aa, Escherichia coli DEC2C
MFWRDMTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKT

SEQ ID NO: 11230 - protein, 713 aa, Escherichia coli DEC2C; identical to SEQ ID NO: 11059

SEQ ID NO: 11231 - protein, 678 aa, Escherichia coli DEC2C; identical to SEQ ID NO: 7829

SEQ ID NO: 11232 - protein, 386 aa, Escherichia coli DEC2C; identical to SEQ ID NO: 7828

SEQ ID NO: 11233 - protein, 660 aa, Escherichia coli DEC2C; identical to SEQ ID NO: 10888

SEQ ID NO: 11234 - protein, 859 aa, Escherichia coli DEC2C; identical to SEQ ID NO: 10831

SEQ ID NO: 11235 - protein, 199 aa, Escherichia coli DEC2C; identical to SEQ ID NO: 7825

SEQ ID NO: 11236 - protein, 514 aa, Escherichia coli DEC2C; identical to SEQ ID NO: 10891

SEQ ID NO: 11237 - protein, 208 aa, Escherichia coli DEC2C; identical to SEQ ID NO: 5869

SEQ ID NO: 11238 - protein, 446 aa, Escherichia coli DEC2C; identical to SEQ ID NO: 5873

SEQ ID NO: 11239 - protein, 237 aa, Escherichia coli DEC2C; identical to SEQ ID NO: 7546

SEQ ID NO: 11240 - protein, 774 aa, Escherichia coli DEC2C; identical to SEQ ID NO: 6673

SEQ ID NO: 11241 - protein, 368 aa, Escherichia coli DEC2C; identical to SEQ ID NO: 7797

SEQ ID NO: 11242 - protein, 241 aa, Escherichia coli DEC2C; identical to SEQ ID NO: 6140

SEQ ID NO: 11243 - protein, 856 aa, Escherichia coli DEC2C; identical to SEQ ID NO: 7799

SEQ ID NO: 11244 - protein, 121 aa, Escherichia coli DEC2D; identical to SEQ ID NO: 6059

SEQ ID NO: 11245 - protein, 368 aa, Escherichia coli DEC2D; identical to SEQ ID NO: 7797

SEQ ID NO: 11246 - protein, 241 aa, Escherichia coli DEC2D; identical to SEQ ID NO: 6140

SEQ ID NO: 11247 - protein, 856 aa, Escherichia coli DEC2D; identical to SEQ ID NO: 7799

SEQ ID NO: 11248 - protein, 170 aa, Escherichia coli DEC2D; identical to SEQ ID NO: 7801

SEQ ID NO: 11249 - protein, 790 aa, Escherichia coli DEC2D; identical to SEQ ID NO: 7802

SEQ ID NO: 11250 - protein, 200 aa, Escherichia coli DEC2D; identical to SEQ ID NO: 7803

SEQ ID NO: 11251 - protein, 238 aa, Escherichia coli DEC2D; identical to SEQ ID NO: 7804

SEQ ID NO: 11252 - protein, 731 aa, Escherichia coli DEC2D; identical to SEQ ID NO: 7805

SEQ ID NO: 11253 - protein, 266 aa, Escherichia coli DEC2D; identical to SEQ ID NO: 7806

SEQ ID NO: 11254 - protein, 161 aa, Escherichia coli DEC2D; identical to SEQ ID NO: 5769

SEQ ID NO: 11255 - protein, 430 aa, Escherichia coli DEC2D; identical to SEQ ID NO: 5758

SEQ ID NO: 11256 - protein, 746 aa, Escherichia coli DEC2D; identical to SEQ ID NO: 7788

SEQ ID NO: 11257 - protein, 351 aa, Escherichia coli DEC2D; identical to SEQ ID NO: 7789

SEQ ID NO: 11258 - protein, 193 aa, Escherichia coli DEC2D; identical to SEQ ID NO: 6300

SEQ ID NO: 11259 - protein, 331 aa, Escherichia coli DEC2D; identical to SEQ ID NO: 7841

SEQ ID NO: 11260 - protein, 760 aa, Escherichia coli DEC2D; identical to SEQ ID NO: 10799

SEQ ID NO: 11261 - protein, 203 aa, Escherichia coli DEC2D; identical to SEQ ID NO: 6414

SEQ ID NO: 11262 - protein, 355 aa, Escherichia coli DEC2D; identical to SEQ ID NO: 7838

SEQ ID NO: 11263 - protein, 191 aa, Escherichia coli DEC2D; identical to SEQ ID NO: 5748

SEQ ID NO: 11264 - protein, 232 aa, Escherichia coli DEC2D; identical to SEQ ID NO: 5747

SEQ ID NO: 11265 - protein, 729 aa, Escherichia coli DEC2D; identical to SEQ ID NO: 7833

SEQ ID NO: 11266 - protein, 213 aa, Escherichia coli DEC2D; identical to SEQ ID NO: 5744

SEQ ID NO: 11267 - protein, 203 aa, Escherichia coli DEC2D; identical to SEQ ID NO: 7809

SEQ ID NO: 11268 - protein, 656 aa, Escherichia coli DEC2D; identical to SEQ ID NO: 7810

SEQ ID NO: 11269 - protein, 565 aa, Escherichia coli DEC2D; identical to SEQ ID NO: 7811

SEQ ID NO: 11270 - protein, 207 aa, Escherichia coli DEC2D; identical to SEQ ID NO: 7812

SEQ ID NO: 11271 - protein, 551 aa, Escherichia coli DEC2D; identical to SEQ ID NO: 7843

SEQ ID NO: 11272 - protein, 700 aa, Escherichia coli DEC2D; identical to SEQ ID NO: 10811

SEQ ID NO: 11273 - protein, 871 aa, Escherichia coli DEC2D; identical to SEQ ID NO: 10869

SEQ ID NO: 11274 - protein, 236 aa, Escherichia coli DEC2D; identical to SEQ ID NO: 7814

SEQ ID NO: 11275 - protein, 386 aa, Escherichia coli DEC2D
MDNAPLPQVISMVWQRVFNRPYQLSPDIAGDTRLVSFYLSKNQEPRSFFISYLKRLNISVTSMKDGVDYISVIKQTEQKVPDVVFTYRPKYRSVSYLSAMLNSVVSSGAFSNHIQSVDYLSGGVSGITTTDSASTRMSIATDAEVLVYSGPAASVRQIEKILPRIDVPAEQVTVSGYVLEVQTTDRNATGLQIIADLFRNKLGMSVGARLDGGNSFTLNVGGLNAFYSLIKEDSRFNVVSNPRLTVLSGSKSQFTVGQEVPVLDSVSYQGSSGTPVQSVTYRNSGAIFTVTPVVLDGLITLDISQQLSDFVKTTTGVNSSPTLTKREISTKVDVKDGELLVLGGLASSKLTQSRTGFSFLPGFTGKSDENNRTDIIVVLQARRVGK

SEQ ID NO: 11276 - protein, 118 aa, Escherichia coli DEC2D [sequence omitted]

SEQ ID NO: 11277 - protein, 111 aa, Escherichia coli DEC2D; identical to SEQ ID NO: 10814

SEQ ID NO: 11278 - protein, 446 aa, Escherichia coli DEC2D; identical to SEQ ID NO: 5873

SEQ ID NO: 11279 - protein, 826 aa, Escherichia coli DEC2D; identical to SEQ ID NO: 7836

SEQ ID NO: 11280 - protein, 165 aa, Escherichia coli DEC2D; identical to SEQ ID NO: 7837

SEQ ID NO: 11281 - protein, 641 aa, Escherichia coli DEC2D; identical to SEQ ID NO: 7819

SEQ ID NO: 11282 - protein, 274 aa, Escherichia coli DEC2D; identical to SEQ ID NO: 5899

SEQ ID NO: 11283 - protein, 249 aa, Escherichia coli DEC2D; identical to SEQ ID NO: 7817

SEQ ID NO: 11284 - protein, 879 aa, Escherichia coli DEC2D; identical to SEQ ID NO: 7818

SEQ ID NO: 11285 - protein, 162 aa, Escherichia coli DEC2D; identical to SEQ ID NO: 5896

SEQ ID NO: 11286 - protein, 371 aa, Escherichia coli DEC2D; identical to SEQ ID NO: 7822

SEQ ID NO: 11287 - protein, 200 aa, Escherichia coli DEC2D; identical to SEQ ID NO: 5898

SEQ ID NO: 11288 - protein, 518 aa, Escherichia coli DEC2D; identical to SEQ ID NO: 7565

SEQ ID NO: 11289 - protein, 432 aa, Escherichia coli DEC2D; identical to SEQ ID NO: 5727

SEQ ID NO: 11290 - protein, 359 aa, Escherichia coli DEC2D; identical to SEQ ID NO: 5847

SEQ ID NO: 11291 - protein, 678 aa, Escherichia coli DEC2D; identical to SEQ ID NO: 7829

SEQ ID NO: 11292 - protein, 686 aa, Escherichia coli DEC2D; identical to SEQ ID NO: 7831

SEQ ID NO: 11293 - protein, 713 aa, Escherichia coli DEC2D; identical to SEQ ID NO: 11059

SEQ ID NO: 11294 - protein, 386 aa, Escherichia coli DEC2D; identical to SEQ ID NO: 8261

SEQ ID NO: 11295 - protein, 660 aa, Escherichia coli DEC2D; identical to SEQ ID NO: 10888

SEQ ID NO: 11296 - protein, 857 aa, Escherichia coli DEC2D
MDGRFAHLHFFFPFSLSVLALTVAGSFSATAGKFNPRFLEDTAGINQHVDLSMYETDHGAQLPGTYRVSLIVNEQKMETRTLEFKAATESQRKEMGEFLIPCLSRTQLADMGVRVDSFSALNLIPAEACVAFNEIIPQATSHFDFSEQKLVMSFPQAAMQQVARGTVPESRWDDGVPALLLDYSFSGSNSSHDTKSYNRYIDENGNHHQDKNETSQTNDSYYLSMRSGLNLGAWSLRNYSNWSYSNGEKQWDNIGTYVTRAIVPLKAQLTLGDTATPSDIFDSVQMRGALLASDEEMLPDSQRGFAPVVRGIAKSNAEVSIEQNGYVIYRAFVQPGAFEINDLYPTANSGDLTVIVKEADGSEQRFIQPFSSVAVFQREGHLKYSLSAGEYRAGNYDSANPRFGQFNAMYGLPFGMTTYGGALISKDYNAFALGLGKNFGSIGAISVDITQAKSTLNNNATDQGQSYRFLYSKSFASGTDFRLLGYKYSTSGFYTFQEATDVRSGADSDYGRYHKRSEIQGNLTQQLGTYGSVYFNMTQQDYWNDDGKRLSLATGYNGRIGRVNYSIAYSWNKSPEWDENDQLWSFNISIPFGRAWSNYRVTTDQDGRTIQQLGVNGTLLEDRNLSYNVQEGYSSNGVGNSGNASLAYQGGAGNISVGYSYGKDYQQTNYSLRGGIVAHSEGISLSQPLGETIAIVSAPGARGAKVLNNSGVSVDWQGNAVVPYLSIYRENDVSIRSETLNDSVDMNSAFQTIVPTRGAVVRAHFDTRVGYRVLMTLIRQNGVSVPFGATATLVSDTTEQISGIVGEDGQLYISGMPKTGNVKIVWGKDTSQQCVAKYELPVEEKNSGIISVTANCQ

SEQ ID NO: 11297 - protein, 199 aa, Escherichia coli DEC2D; identical to SEQ ID NO: 7825

SEQ ID NO: 11298 - protein, 512 aa, Escherichia coli DEC2D; identical to SEQ ID NO: 6120

SEQ ID NO: 11299 - protein, 208 aa, Escherichia coli DEC2D; identical to SEQ ID NO: 5869

SEQ ID NO: 11300 - protein, 237 aa, Escherichia coli DEC2D; identical to SEQ ID NO: 7546

SEQ ID NO: 11301 - protein, 774 aa, Escherichia coli DEC2D; identical to SEQ ID NO: 6673

SEQ ID NO: 11302 - protein, 170 aa, Escherichia coli DEC2E; identical to SEQ ID NO: 7801

SEQ ID NO: 11303 - protein, 798 aa, Escherichia coli DEC2E; identical to SEQ ID NO: 10841

SEQ ID NO: 11304 - protein, 200 aa, Escherichia coli DEC2E; identical to SEQ ID NO: 7803

SEQ ID NO: 11305 - protein, 184 aa, Escherichia coli DEC2E
MQSWVSNIDGSKAPFLITPPVYKLEENRQTLLHIVFTGDKDKLPQDRESLFLANVKSVSAMPEELKDKNILQFAMKARLKLFWRPVSLDNNDALTAWEKLKFHKEAGKLIVKNPTPFYISFNDLTVSGKNIVPVDTKSEPGALLMMVGPFSEQRFSLPAGAGNVVEWSVITDYGSSSGKRKQKL

SEQ ID NO: 11306 - protein, 731 aa, Escherichia coli DEC2E; identical to SEQ ID NO: 7805

SEQ ID NO: 11307 - protein, 266 aa, Escherichia coli DEC2E; identical to SEQ ID NO: 7806

SEQ ID NO: 11308 - protein, 161 aa, Escherichia coli DEC2E; identical to SEQ ID NO: 5769

SEQ ID NO: 11309 - protein, 746 aa, Escherichia coli DEC2E; identical to SEQ ID NO: 7788

SEQ ID NO: 11310 - protein, 193 aa, Escherichia coli DEC2E; identical to SEQ ID NO: 6300

SEQ ID NO: 11311 - protein, 351 aa, Escherichia coli DEC2E; identical to SEQ ID NO: 7789

SEQ ID NO: 11312 - protein, 430 aa, Escherichia coli DEC2E; identical to SEQ ID NO: 5758

SEQ ID NO: 11313 - protein, 331 aa, Escherichia coli DEC2E; identical to SEQ ID NO: 7841

SEQ ID NO: 11314 - protein, 660 aa, Escherichia coli DEC2E; identical to SEQ ID NO: 7840

SEQ ID NO: 11315 - protein, 203 aa, Escherichia coli DEC2E; identical to SEQ ID NO: 6414

SEQ ID NO: 11316 - protein, 355 aa, Escherichia coli DEC2E; identical to SEQ ID NO: 7838

SEQ ID NO: 11317 - protein, 191 aa, Escherichia coli DEC2E; identical to SEQ ID NO: 5748

SEQ ID NO: 11318 - protein, 232 aa, Escherichia coli DEC2E; identical to SEQ ID NO: 5747

SEQ ID NO: 11319 - protein, 729 aa, Escherichia coli DEC2E; identical to SEQ ID NO: 7833

SEQ ID NO: 11320 - protein, 213 aa, Escherichia coli DEC2E; identical to SEQ ID NO: 5744

SEQ ID NO: 11321 - protein, 203 aa, Escherichia coli DEC2E; identical to SEQ ID NO: 7809

SEQ ID NO: 11322 - protein, 656 aa, Escherichia coli DEC2E; identical to SEQ ID NO: 7810

SEQ ID NO: 11323 - protein, 565 aa, Escherichia coli DEC2E; identical to SEQ ID NO: 7811

SEQ ID NO: 11324 - protein, 207 aa, Escherichia coli DEC2E; identical to SEQ ID NO: 7812

SEQ ID NO: 11325 - protein, 407 aa, Escherichia coli DEC2E; identical to SEQ ID NO: 10865

SEQ ID NO: 11326 - protein, 539 aa, Escherichia coli DEC2E; identical to SEQ ID NO: 10810

SEQ ID NO: 11327 - protein, 700 aa, Escherichia coli DEC2E; identical to SEQ ID NO: 10811

SEQ ID NO: 11328 - protein, 111 aa, Escherichia coli DEC2E; identical to SEQ ID NO: 10814

SEQ ID NO: 11329 - protein, 118 aa, Escherichia coli DEC2E [sequence omitted]

SEQ ID NO: 11330 - protein, 318 aa, Escherichia coli DEC2E
MAVKISGVLKDGTGKPVENCTIQLKARRTSSTVVVNTVASENPDEAGRYSMDVEYGQYSVILLVEGFPPSHAGTITVYEDSQPGTLNDFLGAMSEDDVRPEALRRFELMVEEVARHAEEAKKNAGEAETSARNAGISASQAEESAANADTSAGEASESARQAAESAASAKQSEDASSSSASAAAQKASESSQSAAEAELSRKTAESAAGNAARDATTATEKARESAESAQSAEQSRIAAEEAVNRIPTVVGPPGPKGEPGPAGPQGPKGDKGERGDTGPAGATGERGPAGDAGPAGPQGPKGDRGERGETGLTGNAGP

SEQ ID NO: 11331 - protein, 826 aa, Escherichia coli DEC2E; identical to SEQ ID NO: 7836

SEQ ID NO: 11332 - protein, 165 aa, Escherichia coli DEC2E; identical to SEQ ID NO: 7837

SEQ ID NO: 11333 - protein, 631 aa, Escherichia coli DEC2E
MVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTRETPRIEGFSSRDGNVEFAWTPNQNHDFTAGYGFDRQDRDSDSLDKNRLERQNYSVSHNGRWDYGTSELKYYGEKIENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 11334 - protein, 162 aa, Escherichia coli DEC2E; identical to SEQ ID NO: 5896

SEQ ID NO: 11335 - protein, 371 aa, Escherichia coli DEC2E; identical to SEQ ID NO: 7822

SEQ ID NO: 11336 - protein, 200 aa, Escherichia coli DEC2E; identical to SEQ ID NO: 5898

SEQ ID NO: 11337 - protein, 274 aa, Escherichia coli DEC2E; identical to SEQ ID NO: 5899

SEQ ID NO: 11338 - protein, 249 aa, Escherichia coli DEC2E; identical to SEQ ID NO: 7817

SEQ ID NO: 11339 - protein, 879 aa, Escherichia coli DEC2E; identical to SEQ ID NO: 7818

SEQ ID NO: 11340 - protein, 518 aa, Escherichia coli DEC2E; identical to SEQ ID NO: 7565

SEQ ID NO: 11341 - protein, 432 aa, Escherichia coli DEC2E; identical to SEQ ID NO: 5727

SEQ ID NO: 11342 - protein, 359 aa, Escherichia coli DEC2E; identical to SEQ ID NO: 5847

SEQ ID NO: 11343 - protein, 774 aa, Escherichia coli DEC2E; identical to SEQ ID NO: 6673

SEQ ID NO: 11344 - protein, 686 aa, Escherichia coli DEC2E; identical to SEQ ID NO: 7831

SEQ ID NO: 11345 - protein, 711 aa, Escherichia coli DEC2E; identical to SEQ ID NO: 8259

SEQ ID NO: 11346 - protein, 678 aa, Escherichia coli DEC2E; identical to SEQ ID NO: 7829

SEQ ID NO: 11347 - protein, 386 aa, Escherichia coli DEC2E; identical to SEQ ID NO: 7828

SEQ ID NO: 11348 - protein, 660 aa, Escherichia coli DEC2E; identical to SEQ ID NO: 10888

SEQ ID NO: 11349 - protein, 859 aa, Escherichia coli DEC2E; identical to SEQ ID NO: 10831

SEQ ID NO: 11350 - protein, 229 aa, Escherichia coli DEC2E; identical to SEQ ID NO: 11181

SEQ ID NO: 11351 - protein, 512 aa, Escherichia coli DEC2E; identical to SEQ ID NO: 6120

SEQ ID NO: 11352 - protein, 208 aa, Escherichia coli DEC2E; identical to SEQ ID NO: 5869

SEQ ID NO: 11353 - protein, 446 aa, Escherichia coli DEC2E; identical to SEQ ID NO: 5873

SEQ ID NO: 11354 - protein, 237 aa, Escherichia coli DEC2E; identical to SEQ ID NO: 7546

SEQ ID NO: 11355 - protein, 368 aa, Escherichia coli DEC2E; identical to SEQ ID NO: 7797

SEQ ID NO: 11356 - protein, 241 aa, Escherichia coli DEC2E; identical to SEQ ID NO: 6140

SEQ ID NO: 11357 - protein, 856 aa, Escherichia coli DEC2E; identical to SEQ ID NO: 7799

SEQ ID NO: 11358 - protein, 650 aa, Escherichia coli DEC3A
MNGRLPVLVFTTVILGAIPRWGAEFSANFKDTDIQEFINTVSKNLHKTVIINPDVQGTITVRSYDMLNEEQYYQFFLSVLDVYGFAVVDMHNGILKVVRSKDAKTSAVPVASDVSPGTGDEVVTRVVPVSNVAARDLAPLLRQLNDNAGAGSVVHYEPSNVLLMTGRAAVMKRLMEIVERVDKVGNRSVATVPLTYASATDVARLVTELTKETDKTAIPAWMTAKLVADERTNSVLVSGEPISQQRIISIIKQLDRQEDVQGNTKVIYLKYAKAKDLVEVLTGISSSIENDSKKSPSTEALRKGVTIKSHEQTNALILTGAPDVIRDLENVISQLDIRRPQVLVEAIIAEIQDADGLNLGIQWVNKHAGVAQFTSTGLPITTMVQTRQNEILDSDQSNALSMFNGIAAGFYQGNWAMLLTALSTSSKNDILATPSIVTLDNMEATFNVGQEVPVLSGSQTTSGDNIFNTVERKTVGIKLRVKPQINEGDSVLLEIEQEVSGVADTAVATTTDLGATFNTRTVTNAMLVGNGETVVVGGLLDKSIRGSESKVPLLGDIPVLGHLFRAKSEQTAKRNLMLFIRPTIIRERDGFRHASAEKYQSFNQEQVQSRGKETTALTLNEEQLRLSPDQDDTAFRKVKAAIAAFYAQEM

SEQ ID NO: 11359 - protein, 998 aa, Escherichia coli DEC3A; identical to SEQ ID NO: 6058

SEQ ID NO: 11360 - protein, 780 aa, Escherichia coli DEC3A
MKIPTTTDIPQRYTWCLAGICYSSLAILPSFLSYAESYFNPAFLLENGTFVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKILAALCRRKARWFVPILIPA

SEQ ID NO: 11361 - protein, 230 aa, Escherichia coli DEC3A; identical to SEQ ID NO: 5765

SEQ ID NO: 11362 - protein, 366 aa, Escherichia coli DEC3A
MKLKIVAVVVTGLLAANVAHAAEVYNKDGNKLDLYGKVTALRYFTDDKRDDGDKTYARLGFKGETQINDQMIGFGHWEYDFKGYNDEANGSRDNKTRLAYAGLKISEFGSLDYGRNYGVGYDIGSWTDMLPEFGGDTWSQKDVFMTYRTTGVATYRNYDFFGLIEGLNFAAQYQGKNERTDNSHLYGADYTRANGDGFGISSTYVYDGFGIGAVYTKSDRTNAQERAAANPLNASGKNAELWATGIKYDANNIYFAANYAETLNMTTYGDGYISNKAQSFEVVAQYQFDFGLRPSLAYLKSKGIDLGRYGDQDMIEYIDVGATYFFNKNMSTYVDYKINLIDESDFTRAVDIRTDNIVATGITYQF

SEQ ID NO: 11363 - protein, 871 aa, Escherichia coli DEC3A
MHQVLLLPRFARLTIALSLATAVFPVDAEYYFNPRFLSNDLAESVDLSAFTKGREAPPGTYRVDIYLNDEFMTSRDITFITDDNNADLIPCLSTDLLVSLGIKKSALLDNKEHSAEKHVPDNSACTPLQDRLVDASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPRFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGATFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSTLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 11364 - protein, 236 aa, Escherichia coli DEC3A
MQTTRTPYSISFMATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSNLTLINPTPYFITVTNMKAGNSNLPNTMVPPKGEVSVDIPHAATGDISFQTINDYGALTPRIKATMQ

SEQ ID NO: 11365 - protein, 746 aa, Escherichia coli DEC3A; identical to SEQ ID NO: 5761

SEQ ID NO: 11366 - protein, 193 aa, Escherichia coli DEC3A; identical to SEQ ID NO: 5760

SEQ ID NO: 11367 - protein, 243 aa, Escherichia coli DEC3A
MTFVKGFPLILLVASMCSHGAVQPDRTRIIFNSKDKATSLRVENRSDKLPYLAYSWIENEKGEKSDEFLVALPPIQRLEPKATSQVRIMKQAATAKLPTDRESLFYYNLREIPPVPEGSEGHAILQVAVQSRIKLFWRPAALRKKMGDHVEQQLQVSQQNNQLTLKTPTGYYLTIAYLGRDEKGVLPGFKSTMVAPFSSVTTSTGSYSGKQFYLGYMDDYGALRMNTLSCQRQCRLQPVENKK

SEQ ID NO: 11368 - protein, 720 aa, Escherichia coli DEC3A
MNIYRLSVLSCLAMVTPPALTAEFNLNVLDKSIRDSVDISLLNQKGVVAPGDYFVSVTVNNNKISNGQQIRWQKSGDKIIPCINESLIELFGLKSDFRKKLPAIKECVDFSVFPEIIFTFDQANQQLNITIPQAWLAWHSENWTPPSTWNNGIPGFLMDYNLFASTYRPQSGSSSNNLNAYGTTGLNAGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLAAGRPRSSMSHHTEDETFISHEVSWGMLSNTSLYGGMLLAGDDYRSGALGIGQNMLWMGALSFDVTWADSHFDTQQDEQGYSYRFNYSKQVDATNSTISLAAYRFSDRHFHSYANYIDHKYNDADAQDEKQTISLSFGQPITLLNLNLYANILHQSWWNADTSTTANITVGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGAAFHRRSSTNEPRLMVSTDGVGDIPIQGNIDYTNRFGIAVVPFVSSYQPTTVAVNMNDLPDGVTVSENVVKET

SEQ ID NO: 11369 - protein, 430 aa, Escherichia coli DEC3A; identical to SEQ ID NO: 5758

SEQ ID NO: 11370 - protein, 331 aa, Escherichia coli DEC3A; identical to SEQ ID NO: 6551

SEQ ID NO: 11371 - protein, 760 aa, Escherichia coli DEC3A; identical to SEQ ID NO: 5756

SEQ ID NO: 11372 - protein, 203 aa, Escherichia coli DEC3A; identical to SEQ ID NO: 6414

SEQ ID NO: 11373 - protein, 361 aa, Escherichia coli DEC3A
MKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQLLGNGKKAEQWATGLKYDANNIYLAANYGETRNATPITNKFTNISGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 11374 - protein, 224 aa, Escherichia coli DEC3A
MTVSLTAILLSCSSTWAAGKGGVGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIGGKLVKNQMISPFDKYQFSLPKGAKNSSVTYRTINDYGAETPQLNCKS

SEQ ID NO: 11375 - protein, 370 aa, Escherichia coli DEC3A
MQRAVIPLKGELTVGDDYTAGDFFDSVSFRGVQLASDDNMLPDSLKGFAPVVRGIAKSNAQITIKQNGYTIYQTYVSPGAFEISDIYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLSEYGSFYLSGSQQTYWHTDQQDRLLQFGYNTQIKDLSLGISWNYSKSRGQPDADQVFALNFSLPLNLLLSRSNDSYTSKKITPG

SEQ ID NO: 11376 - protein, 173 aa, Escherichia coli DEC3A
MALLIFAVLSLLVAGELQAGVVVGGTRFIFPADRESISILLTNTSQESWLINRKINRPTRWAGGEASTVPAPLLAAPPLILLKPGTTGTLRLLRTESDILPVDRETLFELSIASVPSGKVENQSVKVAMRSVFKLFWRPEGCRATRWKLINNYAGHGSRRVYNSLTQRLITLT

SEQ ID NO: 11377 - protein, 351 aa, Escherichia coli DEC3A
MTERELSIIRALGEEFSTVLADLQRTFEGKMAAQAQAFEEKLASLSAVLQKHVTVDEVHPVLQAMVDDAVGTIPVPRDGRDYDPDVLQQAVNDAVANIPVPADGKSITPDDVRPMLEQMVKEAVSHIPAPRDGRDYDPEVLKQAVNDAVANIPVPADGKSITPDDVRPMLEQMVKEAVSHIPVPRDGRDYDPDVLQKAVLDAVRALPAPQDGRDATALEIIPAIDDQKSFPRGTYATHQGGLWRAYEKTHGMRGWECLVDGVADIDVSMTGERSFTVVVRQSSGQRTEKTFSLPVMLYRGVFRAGETYHPGDTVTWGGSLWHCNSMTEDKPGEAHSSAWTLAAKRGRDAGG

SEQ ID NO: 11378 - protein, 89 aa, Escherichia coli DEC3A; identical to SEQ ID NO: 6233

SEQ ID NO: 11379 - protein, 209 aa, Escherichia coli DEC3A
MPASSRIIYRDGDREKTLMLVNTNDYPVLVQSWVDNGEGSPEAASPPFVVLPPVFRLAARRTQGLRIIYNHDPLPQDRESAFWLNLYEMPPETPHQDPTHLTLAMNTQLKIFYRPKSVTMTPQEAMRKISWHLGNDGSSSYIELNNPTPLNISFTSISIGATKVQQESDMMIKPFSQRRYWLASNNVSGVVAATYLDDNGAQIKQQLAQ

SEQ ID NO: 11380 - protein, 840 aa, Escherichia coli DEC3A
MNKSVVSISAAMLVLLCQPVMGSEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAKELAPGITSQTQLSQLRLDLSVPQSQLISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTTVGLNASKGQDYWQASGNVQGAMAVHGGGITFGPYLGETFALVEAKGAEGAKVYNSSQLEINDSGYALVPAVTPYRYNRISLDPQGMDGDAELVDSERQVAPVAGAAVKVIFRTRPGKALLIKSRMADGSELPMGADVLDENNTVVGIAGQGGQIYLRTEQTKGHLSVRWGEGANDSCQLPFDISGKDSNSPIIRLNETCQS

SEQ ID NO: 11381 - protein, 233 aa, Escherichia coli DEC3A
MNIFAYLLVLVFSMSMSSSAFASVVMTGTRIIFPGDAKEKTIQLRNTSDQPYIINIHVEDERGSDKNVPFMPTPQTFRMEAAAGQALRLLYTGNNLPQDRESVFWFSFSQLPYLNKNDKSQNQLILALTNRVKIFYRPSSIVGKSSDAPKNLTYQVKQNRIEVTNPTGYYVTIRAAELLNNGKKVPLANSVMIAPQSTTEWTLPSGISVAPGAQIHLVTVNDYGVNVTSEHAL

SEQ ID NO: 11382 - protein, 669 aa, Escherichia coli DEC3A; identical to SEQ ID NO: 8890

SEQ ID NO: 11383 - protein, 191 aa, Escherichia coli DEC3A; identical to SEQ ID NO: 5748

SEQ ID NO: 11384 - protein, 232 aa, Escherichia coli DEC3A; identical to SEQ ID NO: 5747

SEQ ID NO: 11385 - protein, 729 aa, Escherichia coli DEC3A; identical to SEQ ID NO: 5745

SEQ ID NO: 11386 - protein, 213 aa, Escherichia coli DEC3A; identical to SEQ ID NO: 5744

SEQ ID NO: 11387 - protein, 539 aa, Escherichia coli DEC3A; identical to SEQ ID NO: 6525

SEQ ID NO: 11388 - protein, 700 aa, Escherichia coli DEC3A; identical to SEQ ID NO: 5740

SEQ ID NO: 11389 - protein, 203 aa, Escherichia coli DEC3A; identical to SEQ ID NO: 6347

SEQ ID NO: 11390 - protein, 656 aa, Escherichia coli DEC3A
MRLKKHYLCTALSLAFTQQAVAAQESDSLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSELGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLTFAVNWKDDVHREKGAPHAAYDRYEDRTWSLASEYQWAAADNVDVVAGISYDWRDSVEAKKHEKDGSITHYDDNNQSAFNWQVMGKYHFVNEDTLALSYYDRKRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFVEEGRNFWAGVEYTF

SEQ ID NO: 11391 - protein, 207 aa, Escherichia coli DEC3A; identical to SEQ ID NO: 5743

SEQ ID NO: 11392 - protein, 351 aa, Escherichia coli DEC3A; identical to SEQ ID NO: 5767

SEQ ID NO: 11393 - protein, 391 aa, Escherichia coli DEC3A
MTVKISGVLKDGTGKPVQNCTIVLKARRTSSTVVVNTVASENPDEAGRYSMDVEYGQYSVILLVEGFPPSHAGTITVYEDSQPGTLNDFLGAMSEDDVRPEALRRFELMVEEAARHAEEAKKNAGEAETSARNAGISASQAEENAANADTSAGDASESARQAAESAAAAKQSEEASSSSASAAAQKASESLQSATDAELSKKTAESAAGNAARDATTAAEKARESAESAQSAEQSRIAAEEAVNRIPTVVGPPGPKGEPGPAGPQGPKGDKGERGDTGPAGATGERGPAGDAGPAGPQGPKGDRGERGETGLTGNAGPQGPKGDTGAAGPAGPQGPKGETGAVARWGQPDLRDRRATRGRHKSVFVWGRRALLRQTAMAGSRVQMVRSSPD

SEQ ID NO: 11394 - protein, 118 aa, Escherichia coli DEC3A [sequence omitted]

SEQ ID NO: 11395 - protein, 191 aa, Escherichia coli DEC3A; identical to SEQ ID NO: 5701

SEQ ID NO: 11396 - protein, 111 aa, Escherichia coli DEC3A; identical to SEQ ID NO: 5738

SEQ ID NO: 11397 - protein, 826 aa, Escherichia coli DEC3A
MLRMTPLASAIVALLLGIEAHAAEETFDTHFMMGGMKGEQVTNLRLDDNQPLPGQYDIDIYVNKQWRGKYEIIVKDNPHETCLTREIVKRLGINSDNFARENQCLTFEQLVQGGSYSWDIGIFRLDLAVPQAWVEELENGYVPPENWERGINAFYTSYYVSQYYSDYKASGNSKSTYVRFNSGLNLLGWQLHSDASFSKTDNNPGEWKSNTLYLEHGFSQILGTLRIGDMYTSADIFDSVRFTGVRLFRDMQMLPNSKQNFTPRVQGIAQSNALVTIEQNGFVVYQKEVPPGPFSISDLQLAGGGADLDVSVKEADGSVTTYLVPYAAVPNMLQPGVSKYDFAAGRSHIEGASKQSDFVQAGYQYGFNNLLTLYGGTMVANNYYAFTLGTGWNTRIGAISVDATKSHSKQDNGDVFDGQSYQIAYNKFLSQTSTRFGLAAWRYSSRDYRTFNDYVWANNKDNYRRDKNDVYDIADYYQNDFGRKNSFSANMSQSLPEGWGSVSLSTLWRDYWGRSGSSKDYQLSYSNNWRRISYTLAASQAYDENHAEEKRFNIFISIPFDWGDDVTTPRRQIYMSNSTTFDDQGFASNNTGLSGTVGNRDQFNYGINLSHQHQGNETTAGANLTWTAPAATVNGSYSQSSTYRQVGASVSGGLVAWSGGVNLANRLSETFAVMHAPGIKDAYVNGQKYRTTNCNGVVVYDGLTPYRENHLMMDVSQSDSETELRGNRKMTAPYRGAVVLVDFDTDQRKPWFIKALRSDGQPLTFGYEVNDMHGHNIGVVGQGSQIFIRTNEIPPAVNVAIDKQQGLSCTITFGKEIDESKNYICR

SEQ ID NO: 11398 - protein, 224 aa, Escherichia coli DEC3A
MKGLLSLLISSMIFPVHAGMVIFGTRIIYPAEQKEVMVQLMNQGNRSSLMQAWIDDGDTSLPPEKIQVPFMLTPPVVKVAANSGQQIKIKIMPNKLPSNKESIFYLNVLDIPPNSPEDEGKNALKFAMQNRIKLFYRPAGIAPVNKTTFKKLRVSRSGNNVVIKNDSPNWVTISDVKANNVKVNYETIMIAPQESQNVSEKNNNANGWQLTIIDDHGNYISDKI

SEQ ID NO: 11399 - protein, 61 aa, Escherichia coli DEC3A
MEYTKYNDDDTFTVKVGDKELFTNRWNLQSLLLSAQITGMTVTIKTNACHNGGGFSEVIFR

SEQ ID NO: 11400 - protein, 518 aa, Escherichia coli DEC3A
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMQDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 11401 - protein, 627 aa, Escherichia coli DEC3A
MVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 11402 - protein, 162 aa, Escherichia coli DEC3A; identical to SEQ ID NO: 5734

SEQ ID NO: 11403 - protein, 367 aa, Escherichia coli DEC3A; identical to SEQ ID NO: 5700

SEQ ID NO: 11404 - protein, 200 aa, Escherichia coli DEC3A; identical to SEQ ID NO: 5732

SEQ ID NO: 11405 - protein, 274 aa, Escherichia coli DEC3A; identical to SEQ ID NO: 5731

SEQ ID NO: 11406 - protein, 252 aa, Escherichia coli DEC3A
MTNLFCSARTAATTLALLITAASLSVQASVTPDRTRLIFNESDKSISVTLRNNDPKMPYLAQSWMEDGQGNRISSPLTVLPPVQRIDSMMNGQVKVQGMPDINKLPADRESVFYFNVREIPPKSNKPNTLQIALQTRIKLFWRPKALENVSMKNPWQHKVTLTLSGQEFTVNNPTPYFVVISNASAQKNGNPAAGFSPMVISPKTSVPLKVKMDSVPVLTYVNDYGARLPLFFRCTGNTCQVDEEQNSKGQG

SEQ ID NO: 11407 - protein, 860 aa, Escherichia coli DEC3A
MSGSYVNAWAENEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDITHSHTRLDKETAYGKGSLDGNSFRLSYSKDFDELNSRVTFAGYRFSEENFMTMSEYLDASDSEMVRTGNDKEMYTATYNQNFRDAGVSVYLNYTRHTYWDRDEQTNYNVMLSHYFNLGSIRNMSISMTGYRYEYDNQADKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQGTLTEGAIGYRKFSVISGQKAMAVLRLQDGSYPPFGAEVKNDSAQNVGLVDDDGNVYLAGVKPGEHMIVSWGGVAHCDIHLPDPLPADLFNGLLLPCQQTGAISPSMPHEIKPVIQEQTQQVMPTEAPVSVSAN

SEQ ID NO: 11408 - protein, 432 aa, Escherichia coli DEC3A; identical to SEQ ID NO: 5727

SEQ ID NO: 11409 - protein, 567 aa, Escherichia coli DEC3A
MKIKLRITIILISVLCIFNGLLTPGAYAAAANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGDGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 11410 - protein, 359 aa, Escherichia coli DEC3A
MKKYLALALIAPLLISCSTTKKGGTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 11411 - protein, 713 aa, Escherichia coli DEC3A
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHCVSRRSATNGADYYLPGYFVADAFAAYKMKLQYPVTLQLNVKNLFDKTYYTSSIATNNLGNQIGDPREVQFTVKMEF

SEQ ID NO: 11412 - protein, 231 aa, Escherichia coli DEC3A; identical to SEQ ID NO: 5724

SEQ ID NO: 11413 - protein, 838 aa, Escherichia coli DEC3A; identical to SEQ ID NO: 5723

SEQ ID NO: 11414 - protein, 678 aa, Escherichia coli DEC3A; identical to SEQ ID NO: 5722

SEQ ID NO: 11415 - protein, 386 aa, Escherichia coli DEC3A
MVDDVPVAQVLQALAEQEKLNLVVSPDVSGTVSLHLTDVPWKQALQTVVKSAGLITRQEGNILSVHSIAWQNDNIARQEAEQARAQANLPLENRNITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 11416 - protein, 660 aa, Escherichia coli DEC3A; identical to SEQ ID NO: 6039

SEQ ID NO: 11417 - protein, 367 aa, Escherichia coli DEC3A
MSRKTVSRTFSSFSISVVAVAVASTFSAHAGKFNPKFLEDVQGVGQHVDLTMFEKGQEQQLPGIYRVSVYVNEQRMETRTLEFKEATEAQRKAMGESLVPCLSRTQLAEMGVRVESFPALNLVSAEACVPFDEIIPLASSHFDFSEQKLVLSFPQAAMHQVARGTVPESLWDEGIPALLLDYSFSGSNSEYDSTGSSSSYVDDNGTVHHDDGKDTLKSDSYYLNLRSGLNLGAWRLRNYSTWSHSGGKAQWDNIGTSLSRAIIPFKAQLTMGDTATAGDIFDSVQMRGAMLASDEEMLPDSQRGFAPIVRGIAKSNAEVSIEQNGYVIYRTYVQPGAFEINDLYPTANSGDLTVIIKEADGSEQRFI

SEQ ID NO: 11418 - protein, 229 aa, Escherichia coli DEC3A
MMKSKFVALALSLFLSQSVLAGGVGLSSTRVIYDGSKKEASLTVQNKSKTEEFLIQSWVDDAAGSKKTPFIITPPLFKLDPEKNNILRIVNITPGLPQDRESVYWVNVKAIPSKSDDSENKNVLQIAVRTRIKLFYRPAGLKGDVKTAPNELRFTRNGNQLRVDNPTVFNITFNQFFANDKEIEKAGMVPAKGALNITLPAGVGSVSKIKYNTINDFGSSAEMITKNVD

SEQ ID NO: 11419 - protein, 512 aa, Escherichia coli DEC3A; identical to SEQ ID NO: 5948

SEQ ID NO: 11420 - protein, 125 aa, Escherichia coli DEC3A
MYLLRLFFAVTLITQMSMATAGIVVGGTRVIFYGDKPDTTISIFNKETNLPYLLQTWVDPFNKEDKSKPPFSVIPPVSRIEPQQEKILRILKTAGELPKDRESVFWLNVKNIPPSIDKKIPMFLR

SEQ ID NO: 11421 - protein, 208 aa, Escherichia coli DEC3A; identical to SEQ ID NO: 5717

SEQ ID NO: 11422 - protein, 614 aa, Escherichia coli DEC3A; identical to SEQ ID NO: 5715

SEQ ID NO: 11423 - protein, 446 aa, Escherichia coli DEC3A; identical to SEQ ID NO: 5714

SEQ ID NO: 11424 - protein, 237 aa, Escherichia coli DEC3A; identical to SEQ ID NO: 5713

SEQ ID NO: 11425 - protein, 368 aa, Escherichia coli DEC3A
MNKTITALAILMASFAANASVLPETPVPFKSGTGAIDNDTVYIGLGSAGTAWYKLETQAKDKKWTALAAFPGGPRDQATSAFIDGNLYVFGGIGKNSEGLTQVFNDVHKYNPKTNSWVKLISHAPMGMAGHVTFVHNGKAYVTGGVNQNIFNGYFEDLNEAGKDSTAVDKINAHYFDKKAEDYFFNKFLLSFDPSTQQWSYAGESPWYGTAGAAVVNKGDKTWLINGEAKPGLRTDAVFELDFTGNNLKWNRLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 11426 - protein, 241 aa, Escherichia coli DEC3A; identical to SEQ ID NO: 5709

SEQ ID NO: 11427 - protein, 863 aa, Escherichia coli DEC3A
MHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLARNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 11428 - protein, 816 aa, Escherichia coli DEC3A
MLRTTRWVAAIIFLYSFPGYAEETFDTHFMIGGMKGEKVSEYHFDNKQPLPGNYELDFYVNNQWRGKQDITIPESPVKPCLPKVLLTKLGVKTGNLNTEDNCILLDKAVHGGQYQWDISEHRLNLTVPQAYINELERGYVPPESWDRGIDAFYTSYNLSQYRSYDSNNNSNTASYGRFNSGLNLFSWQLHSDASYSKPDDMKGTWQSNTLYLEHGWSQILSTVQIGENYTSSLIFDSLRFSGIRLFRDMQMLPDSMQSFTPLVQGVAQSNALITVSQNGYIIYQKEVPPGPFTIADLQLSGSGSDLDVSIKEADGSVRSFLVPYSSVPNMLQPGISNFDFIAGRSKIYGVKNQEDFLEANYIYGLNNLLTLYGGTILSDNYNAITLGNGWNTPLGAISFDATRSSSKLNNDITHEGTSYQVAYNKYLVQTATRFSVAAWRYASQDYRTFSDHLYENDKINHQSDYDDFYDIGRKNSLSANIMQPLSNNLGNVSLSALWRNYWGRSGNAKDYQFSYSNSWQRISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPIATIDGSYSHSKNAWQSGGSISSGLVVWPGGINITNQLSDTFAILDAPGLEGAHINGQKYNRTNSKGQVVYDLMIPHRENHLVLDTANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 11429 - protein, 227 aa, Escherichia coli DEC3A
MRIITALLMSFFILPVHAGVVIYGTRIIYPEKNREVLVQLMNQSKNASLIQAWIDDGNTTIAPEKIQVTFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSHNDITLKNNHASEYELTVVDDYGNNIHSKIAAR

SEQ ID NO: 11430 - protein, 170 aa, Escherichia coli DEC3A; identical to SEQ ID NO: 5855

SEQ ID NO: 11431 - protein, 241 aa, Escherichia coli DEC3A
MFPLVKKTVSALFVSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRPSGLQGEPAEAPAKITWKLNNAQLQANNPTPYYVSFNEVKLESGGKTYNVNSSMVTPFSQASFGVTSLPGSVSSGKVVFKAINDFGGNIDGSATF

SEQ ID NO: 11432 - protein, 747 aa, Escherichia coli DEC3A; identical to SEQ ID NO: 5774

SEQ ID NO: 11433 - protein, 266 aa, Escherichia coli DEC3A; identical to SEQ ID NO: 5771

SEQ ID NO: 11434 - protein, 161 aa, Escherichia coli DEC3A; identical to SEQ ID NO: 5769

SEQ ID NO: 11435 - protein, 747 aa, Escherichia coli DEC3B; identical to SEQ ID NO: 5774

SEQ ID NO: 11436 - protein, 266 aa, Escherichia coli DEC3B; identical to SEQ ID NO: 5771

SEQ ID NO: 11437 - protein, 161 aa, Escherichia coli DEC3B; identical to SEQ ID NO: 5769

SEQ ID NO: 11438 - protein, 230 aa, Escherichia coli DEC3B; identical to SEQ ID NO: 5765

SEQ ID NO: 11439 - protein, 869 aa, Escherichia coli DEC3B; identical to SEQ ID NO: 5763

SEQ ID NO: 11440 - protein, 746 aa, Escherichia coli DEC3B; identical to SEQ ID NO: 5761

SEQ ID NO: 11441 - protein, 193 aa, Escherichia coli DEC3B; identical to SEQ ID NO: 5760

SEQ ID NO: 11442 - protein, 243 aa, Escherichia coli DEC3B; identical to SEQ ID NO: 11367

SEQ ID NO: 11443 - protein, 720 aa, Escherichia coli DEC3B; identical to SEQ ID NO: 11368

SEQ ID NO: 11444 - protein, 430 aa, Escherichia coli DEC3B; identical to SEQ ID NO: 5758

SEQ ID NO: 11445 - protein, 331 aa, Escherichia coli DEC3B; identical to SEQ ID NO: 6551

SEQ ID NO: 11446 - protein, 760 aa, Escherichia coli DEC3B; identical to SEQ ID NO: 5756

SEQ ID NO: 11447 - protein, 203 aa, Escherichia coli DEC3B; identical to SEQ ID NO: 6414

SEQ ID NO: 11448 - protein, 361 aa, Escherichia coli DEC3B; identical to SEQ ID NO: 11373

SEQ ID NO: 11449 - protein, 224 aa, Escherichia coli DEC3B; identical to SEQ ID NO: 11374

SEQ ID NO: 11450 - protein, 370 aa, Escherichia coli DEC3B; identical to SEQ ID NO: 11375

SEQ ID NO: 11451 - protein, 170 aa, Escherichia coli DEC3B
MIFAVLSLLVAGELQAGVVVGGTRFIFPADRESISILLTNTSQESWLINRKINRPTRWAGGEASTVPAPLLAAPPLILLKPGTTGTLRLLRTESDILPVDRETLFELSIASVPSGKVENQSVKVAMRSVFKLFWRPEGCRATRWKLINNYAGHGSRRVYNSLTQRLITLT

SEQ ID NO: 11452 - protein, 669 aa, Escherichia coli DEC3B; identical to SEQ ID NO: 8890

SEQ ID NO: 11453 - protein, 351 aa, Escherichia coli DEC3B; identical to SEQ ID NO: 5767

SEQ ID NO: 11454 - protein, 86 aa, Escherichia coli DEC3B
MFMAVLFALASVNAMAADCAKGKIEFSKYNEDDTFTVKVDGKEYWTSRWNLQPLLQSAQLTGMTVTIKSSTCESGSGFAEVQFNND

SEQ ID NO: 11455 - protein, 229 aa, Escherichia coli DEC3B
MKSVLLLLTILFVQSVEAGIMPASSRIIYRDGDREKTLMLVNTNDYPVLVQSWVDNGEGSPEAASPPFVVLPPVFRLAARRTQGLRIIYNHDPLPQDRESAFWLNLYEMPPETPHQDPTHLTLAMNTQLKIFYRPKSVTMTPQEAMRKISWHLGNDGSSSYIELNNPTPLNISFTSISIGATKVQQESDMMIKPFSQRRYWLASNNVSGVVAATYLDDNGAQIKQQLAQ

SEQ ID NO: 11456 - protein, 835 aa, Escherichia coli DEC3B
MSISAAMLVLLCQPVMGSEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAKELAPGITSQTQLSQLRLDLSVPQSQLISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTTVGLNASKGQDYWQASGNVQGAMAVHGGGITFGPYLGETFALVEAKGAEGAKVYNSSQLEINDSGYALVPAVTPYRYNRISLDPQGMDGDAELVDSERQVAPVAGAAVKVIFRTRPGKALLIKSRMADGSELPMGADVLDENNTVVGIAGQGGQIYLRTEQTKGHLSVRWGEGANDSCQLPFDISGKDSNSPIIRLNETCQS

SEQ ID NO: 11457 - protein, 233 aa, Escherichia coli DEC3B; identical to SEQ ID NO: 11381

SEQ ID NO: 11458 - protein, 191 aa, Escherichia coli DEC3B; identical to SEQ ID NO: 5748

SEQ ID NO: 11459 - protein, 232 aa, Escherichia coli DEC3B; identical to SEQ ID NO: 5747

SEQ ID NO: 11460 - protein, 729 aa, Escherichia coli DEC3B; identical to SEQ ID NO: 5745

SEQ ID NO: 11461 - protein, 213 aa, Escherichia coli DEC3B; identical to SEQ ID NO: 5744

SEQ ID NO: 11462 - protein, 656 aa, Escherichia coli DEC3B; identical to SEQ ID NO: 11390

SEQ ID NO: 11463 - protein, 207 aa, Escherichia coli DEC3B; identical to SEQ ID NO: 5743

SEQ ID NO: 11464 - protein, 362 aa, Escherichia coli DEC3B
MAVKISGVLKDGTGKPVENCTIQLKARRNSATVVVNTVASENPDEAGRYSMDVEYGQYSVILLVEGFPPSHAGTITVYEDSQPGTLNDFLGAMSEDDVRPEALRRFELMVEEAARHAEEAKKNAGEAETSARNAGISASQAEESAANADTSAGDASESARQAAESAAAAKQSEEASSSSASAAAQKASESSQSAADAELSKKTAESAAGNAARDATTATEKARESAESAQSAEQSRIAAEEAVNRIPTVVGPPGPKGEPGPAGPQGPKGDKGERGDTGPAGATGERGPAGDAGPAGPAGPAGPQGPKGETGAAGPVGATGPQGPKGDPGETANTVPSGAGKRLLRQTAMAGSRIQMAHSSPD

SEQ ID NO: 11465 - protein, 998 aa, Escherichia coli DEC3B; identical to SEQ ID NO: 6058

SEQ ID NO: 11466 - protein, 655 aa, Escherichia coli DEC3B
MFRKWLNGRLPVLVFTTVILGAIPGWGAEFSANFKDTDIQEFINTVSKNLHKTVIINPDVQGTITVRSYDMLNEEQYYQFFLSVLDVYGFAVVDMHNGILKVVRSKDAKTSAVPVASDVSPGTGDEVVTRVVPVSNVAARDLAPLLRQLNDNAGAGSVVHYEPSNVLLMTGRAAVMKRLMEIVERVDKVGNRSVATVPLTYASATDVARLVTELTKETDKTAIPAWMTAKLVADERTNSVLVSGEPISQQRIISIIKQLDRQEDVQGNTKVIYLKYAKAKDLVEVLTGISSSIENDSKKSPSTEALRKGVTIKSHEQTNALILTGAPDVIRDLENVISQLDIRRPQVLVEAIIAEIQDADGLNLGIQWVNKHAGVAQFTSTGLPITTMVQTRQNEILDSDQSNALSMFNGIAAGFYQGNWAMLLTALSTSSKNDILATPSIVTLDNMEATFNVGQEVPVLSGSQTTSGDNIFNTVERKTVGIKLRVKPQINEGDSVLLEIEQEVSGVADTAVATTTDLGATFNTRTVTNAMLVGNGETVVVGGLLDKSIRGSESKVPLLGDIPVLGHLFRAKSEQTAKRNLMLFIRPTIIRERDGFRHASAEKYQSFNQEQVQSRGKETTALTLNEEQLRLSPDQDDTAFRKVKAAIAAFYAQEM

SEQ ID NO: 11467 - protein, 236 aa, Escherichia coli DEC3B; identical to SEQ ID NO: 11364

SEQ ID NO: 11468 - protein, 366 aa, Escherichia coli DEC3B; identical to SEQ ID NO: 11362

SEQ ID NO: 11469 - protein, 700 aa, Escherichia coli DEC3B; identical to SEQ ID NO: 5740

SEQ ID NO: 11470 - protein, 539 aa, Escherichia coli DEC3B; identical to SEQ ID NO: 6525

SEQ ID NO: 11471 - protein, 461 aa, Escherichia coli DEC3B
MTERELSIIRALGEEFSTVLADLQRTFEEKIAAQAQTFEEKLASQSVVLQKCVTGDDVRPMLEQMVKEAVSHIPVPRDGRDYDPDVLQKAVNDAVANIPVPADGKSITPDDVRPMLEQMVKEAVSHIPVPRDGRDYDPDVLQKAVNDAVAKIPVPADGKSITPDDVHPMLEQMVKEAVSHIPVPRDGRDYDPDVLQKAVLEAVSALPAPQDGRDATALEILPAIDDQKSFPRGSYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGGWKVTALLTLEEIKAHLRVDHDADDEMLMDKVRQATAVLLAYIQGSRDKVISEDGELIPGEALTRMKGAAMRLTGMLYRNPDLAEREDLVQGELPFSVSVLIYDLRCPTVL

SEQ ID NO: 11472 - protein, 351 aa, Escherichia coli DEC3B
MTERELSIIRALGEEFSTVLADLQRTFEGKMASQAQAFEEKLASLSAVLQKHVTVDEVHPVLQAMVDDAVGTIPVPRDGRDYDPDVLQQAVNDAVANIPVPADGKSITPDDVRPMLEQMVKEAVSHIPAPRDGRDYDPEVLKQAVNDAVANIPVPADGKSITPDDVRPMLEQMVKEAVSHIPVPRDGRDYDPDVLQKAVLDAVRALPAPQDGRDATALEIIPAIDDQKSFPRGTYATHQGGLWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRDAGG

SEQ ID NO: 11473 - protein, 111 aa, Escherichia coli DEC3B; identical to SEQ ID NO: 5738

SEQ ID NO: 11474 - protein, 118 aa, Escherichia coli DEC3B [sequence omitted]

SEQ ID NO: 11475 - protein, 191 aa, Escherichia coli DEC3B; identical to SEQ ID NO: 5701

SEQ ID NO: 11476 - protein, 826 aa, Escherichia coli DEC3B; identical to SEQ ID NO: 11397

SEQ ID NO: 11477 - protein, 224 aa, Escherichia coli DEC3B; identical to SEQ ID NO: 11398

SEQ ID NO: 11478 - protein, 89 aa, Escherichia coli DEC3B; identical to SEQ ID NO: 6232

SEQ ID NO: 11479 - protein, 162 aa, Escherichia coli DEC3B; identical to SEQ ID NO: 5734

SEQ ID NO: 11480 - protein, 367 aa, Escherichia coli DEC3B; identical to SEQ ID NO: 5700

SEQ ID NO: 11481 - protein, 200 aa, Escherichia coli DEC3B; identical to SEQ ID NO: 5732

SEQ ID NO: 11482 - protein, 274 aa, Escherichia coli DEC3B; identical to SEQ ID NO: 5731

SEQ ID NO: 11483 - protein, 252 aa, Escherichia coli DEC3B; identical to SEQ ID NO: 11406

SEQ ID NO: 11484 - protein, 860 aa, Escherichia coli DEC3B; identical to SEQ ID NO: 11407

SEQ ID NO: 11485 - protein, 637 aa, Escherichia coli DEC3B
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 11486 - protein, 518 aa, Escherichia coli DEC3B; identical to SEQ ID NO: 11400

SEQ ID NO: 11487 - protein, 359 aa, Escherichia coli DEC3B; identical to SEQ ID NO: 11410

SEQ ID NO: 11488 - protein, 713 aa, Escherichia coli DEC3B; identical to SEQ ID NO: 11411

SEQ ID NO: 11489 - protein, 231 aa, Escherichia coli DEC3B; identical to SEQ ID NO: 5724

SEQ ID NO: 11490 - protein, 838 aa, Escherichia coli DEC3B; identical to SEQ ID NO: 5723

SEQ ID NO: 11491 - protein, 678 aa, Escherichia coli DEC3B; identical to SEQ ID NO: 5722

SEQ ID NO: 11492 - protein, 386 aa, Escherichia coli DEC3B; identical to SEQ ID NO: 11415

SEQ ID NO: 11493 - protein, 629 aa, Escherichia coli DEC3B
MTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVGASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 11494 - protein, 432 aa, Escherichia coli DEC3B; identical to SEQ ID NO: 5727

SEQ ID NO: 11495 - protein, 567 aa, Escherichia coli DEC3B; identical to SEQ ID NO: 11409

SEQ ID NO: 11496 - protein, 514 aa, Escherichia coli DEC3B
MCNEKNKFFIFTALFCCSAQAAPSSLEKRLGKSEYFIITKSSPVRAILNDFAANYSIPVFISSSVNDDFSGEIKNEKPVKVLEKLSKLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQANISSSVISNASNFMIRVNALQQNSKAKILSQPSIITLNNMQAILDKNVTFYTKVSGEKVASLESITSGTLLRVTPRILDDSSNSLTGKRRERVRLLLDIQDGNQSTNQSNAQDASSTLPEVQNSEMTTEATLSAGESLLLGGFIQDKESSSKDGIPLLSDIPVIGSLFSSTVKQKHSVVRLFLIKATPIKSASSE

SEQ ID NO: 11497 - protein, 110 aa, Escherichia coli DEC3B
MSMATAGIVVGGTRVIFYGDKPDTTISIFNKETNLPYLLQTWVDPFNKEDKSKPPFSVIPPVSRIEPQQEKILRILKTAGELPKDRESVFWLNVKNIPPSIDKKIPMFLR

SEQ ID NO: 11498 - protein, 324 aa, Escherichia coli DEC3B
MGQHVDLTMFEKGQEQQLPGIYRVSVYVNEQRMETRTLEFKEATEAQRKAMGESLVPCLSRTQLAEMGVRVESFPALNLVSAEACVPFDEIIPLASSHFDFSEQKLVLSFPQAAMHQVARGTVPESLWDEGIPALLLDYSFSGSNSEYDSTGSSSSYVDDNGTVHHDDGKDTLKSDSYYLNLRSGLNLGAWRLRNYSTWSHSGGKAQWDNIGTSLSRAIIPFKAQLTMGDTATAGDIFDSVQMRGAMLASDEEMLPDSQRGFAPIVRGIAKSNAEVSIEQNGYVIYRTYVQPGAFEINDLYPTANSGDLTVIIKEADGSEQRFI

SEQ ID NO: 11499 - protein, 228 aa, Escherichia coli DEC3B
MKSKFVALALSLFLSQSVLAGGVGLSSTRVIYDGSKKEASLTVQNKSKTEEFLIQSWVDDAAGSKKTPFIITPPLFKLDPEKNNILRIVNITPGLPQDRESVYWVNVKAIPSKSDDSENKNVLQIAVRTRIKLFYRPAGLKGDVKTAPNELRFTRNGNQLRVDNPTVFNITFNQFFANDKEIEKAGMVPAKGALNITLPAGVGSVSKIKYNTINDFGSSAEMITKNVD

SEQ ID NO: 11500 - protein, 208 aa, Escherichia coli DEC3B; identical to SEQ ID NO: 5717

SEQ ID NO: 11501 - protein, 614 aa, Escherichia coli DEC3B; identical to SEQ ID NO: 5715

SEQ ID NO: 11502 - protein, 228 aa, Escherichia coli DEC3B
MSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRPSGLQGEPAEAPAKITWKLNNAQLQANNPTPYYVSFNEVKLESGGKTYNVNSSMVTPFSQASFGVTSLPGSVSSGKVVFKAINDFGGNIDGSATF

SEQ ID NO: 11503 - protein, 446 aa, Escherichia coli DEC3B; identical to SEQ ID NO: 5714

SEQ ID NO: 11504 - protein, 237 aa, Escherichia coli DEC3B; identical to SEQ ID NO: 5713

SEQ ID NO: 11505 - protein, 478 aa, Escherichia coli DEC3B; identical to SEQ ID NO: 5711

SEQ ID NO: 11506 - protein, 368 aa, Escherichia coli DEC3B; identical to SEQ ID NO: 11425

SEQ ID NO: 11507 - protein, 241 aa, Escherichia coli DEC3B; identical to SEQ ID NO: 5709

SEQ ID NO: 11508 - protein, 878 aa, Escherichia coli DEC3B; identical to SEQ ID NO: 5707

SEQ ID NO: 11509 - protein, 219 aa, Escherichia coli DEC3B
MSFFILPVHAGVVIYGTRIIYPEKNREVLVQLMNQSKNASLIQAWIDDGNTTIAPEKIQVTFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSHNDITLKNNHASEYELTVVDDYGNNIHSKIAAR

SEQ ID NO: 11510 - protein, 784 aa, Escherichia coli DEC3B; identical to SEQ ID NO: 5705

SEQ ID NO: 11511 - protein, 170 aa, Escherichia coli DEC3B; identical to SEQ ID NO: 5855

SEQ ID NO: 11512 - protein, 784 aa, Escherichia coli DEC3C; identical to SEQ ID NO: 5705

SEQ ID NO: 11513 - protein, 241 aa, Escherichia coli DEC3C; identical to SEQ ID NO: 11431

SEQ ID NO: 11514 - protein, 747 aa, Escherichia coli DEC3C; identical to SEQ ID NO: 5774

SEQ ID NO: 11515 - protein, 266 aa, Escherichia coli DEC3C; identical to SEQ ID NO: 5771

SEQ ID NO: 11516 - protein, 161 aa, Escherichia coli DEC3C; identical to SEQ ID NO: 5769

SEQ ID NO: 11517 - protein, 368 aa, Escherichia coli DEC3C; identical to SEQ ID NO: 11425

SEQ ID NO: 11518 - protein, 241 aa, Escherichia coli DEC3C; identical to SEQ ID NO: 5709

SEQ ID NO: 11519 - protein, 863 aa, Escherichia coli DEC3C; identical to SEQ ID NO: 11427

SEQ ID NO: 11520 - protein, 170 aa, Escherichia coli DEC3C; identical to SEQ ID NO: 5855

SEQ ID NO: 11521 - protein, 816 aa, Escherichia coli DEC3C; identical to SEQ ID NO: 11428

SEQ ID NO: 11522 - protein, 151 aa, Escherichia coli DEC3C
MRIITALLMSFFILPVHAGVVIYGTRIIYPEKNREVLVQLMNQSKNASLIQAWIDDGNTTIAPEKIQVTFILTPPVSRVAGGSGQQLKIRKMPNNLPHNKESLFYLNVLDIPPNNPQNAGKNKIKLALQNRIKLLWRPSGIAPVDKKAFLN

SEQ ID NO: 11523 - protein, 230 aa, Escherichia coli DEC3C; identical to SEQ ID NO: 5765

SEQ ID NO: 11524 - protein, 869 aa, Escherichia coli DEC3C; identical to SEQ ID NO: 5763

SEQ ID NO: 11525 - protein, 193 aa, Escherichia coli DEC3C; identical to SEQ ID NO: 5760

SEQ ID NO: 11526 - protein, 746 aa, Escherichia coli DEC3C
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHPRNSRIPEGLAGGTEGKFNEKATQDFVDNDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGITWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 11527 - protein, 243 aa, Escherichia coli DEC3C; identical to SEQ ID NO: 11367

SEQ ID NO: 11528 - protein, 720 aa, Escherichia coli DEC3C; identical to SEQ ID NO: 11368

SEQ ID NO: 11529 - protein, 430 aa, Escherichia coli DEC3C; identical to SEQ ID NO: 5758

SEQ ID NO: 11530 - protein, 203 aa, Escherichia coli DEC3C; identical to SEQ ID NO: 6414

SEQ ID NO: 11531 - protein, 331 aa, Escherichia coli DEC3C; identical to SEQ ID NO: 6551

SEQ ID NO: 11532 - protein, 760 aa, Escherichia coli DEC3C; identical to SEQ ID NO: 5756

SEQ ID NO: 11533 - protein, 361 aa, Escherichia coli DEC3C; identical to SEQ ID NO: 11373

SEQ ID NO: 11534 - protein, 224 aa, Escherichia coli DEC3C; identical to SEQ ID NO: 11374

SEQ ID NO: 11535 - protein, 370 aa, Escherichia coli DEC3C; identical to SEQ ID NO: 11375

SEQ ID NO: 11536 - protein, 173 aa, Escherichia coli DEC3C; identical to SEQ ID NO: 11376

SEQ ID NO: 11537 - protein, 669 aa, Escherichia coli DEC3C; identical to SEQ ID NO: 8890

SEQ ID NO: 11538 - protein, 998 aa, Escherichia coli DEC3C; identical to SEQ ID NO: 6058

SEQ ID NO: 11539 - protein, 650 aa, Escherichia coli DEC3C
MNGRLPVLVFTTVILGAIPGWGAEFSANFKDTDIQEFINTVSKNLHKTVIINPDVQGTITVRSYDMLNEEQYYQFFLSVLDVYGFAVVDMHNGILKVVRSKDAKTSAVPVASDVSPGTGDEVVTRVVPVSNVAARDLAPLLRQLNDNAGAGSVVHYEPSNVLLMTGRAAVMKRLMEIVERVDKVGNRSVATVPLTYASATDVARLVTELTKETDKTAIPAWMTAKLVADERTNSVLVSGEPISQQRIISIIKQLDRQEDVQGNTKVIYLKYAKAKDLVEVLTGISSSIENDSKKSPSTEALRKGVTIKSHEQTNALILTGAPDVIRDLENVISQLDIRRPQVLVEAIIAEIQDADGLNLGIQWVNKHAGVAQFTSTGLPITTMVQTRQNEILDSDQSNALSMFNGIAAGFYQGNWAMLLTALSTSSKNDILATPSIVTLDNMEATFNVGQEVPVLSGSQTTSGDNIFNTVERKTVGIKLRVKPQINEGDSVLLEIEQEVSGVADTAVATTTDLGATFNTRTVTNAMLVGNGETVVVGGLLDKSIRGSESKVPLLGDIPVLGHLFRAKSEQTAKRNLMLFIRPTIIRERDGFRHASAEKYQSFNQEQVQSRGKETTALTLNEEQLRLSPDQDDTAFRKVKAAIAAFYAQEM

SEQ ID NO: 11540 - protein, 89 aa, Escherichia coli DEC3C; identical to SEQ ID NO: 6233

SEQ ID NO: 11541 - protein, 209 aa, Escherichia coli DEC3C; identical to SEQ ID NO: 11379

SEQ ID NO: 11542 - protein, 840 aa, Escherichia coli DEC3C; identical to SEQ ID NO: 11380

SEQ ID NO: 11543 - protein, 233 aa, Escherichia coli DEC3C; identical to SEQ ID NO: 11381

SEQ ID NO: 11544 - protein, 191 aa, Escherichia coli DEC3C; identical to SEQ ID NO: 5748

SEQ ID NO: 11545 - protein, 232 aa, Escherichia coli DEC3C; identical to SEQ ID NO: 5747

SEQ ID NO: 11546 - protein, 729 aa, Escherichia coli DEC3C; identical to SEQ ID NO: 5745

SEQ ID NO: 11547 - protein, 213 aa, Escherichia coli DEC3C; identical to SEQ ID NO: 5744

SEQ ID NO: 11548 - protein, 203 aa, Escherichia coli DEC3C; identical to SEQ ID NO: 6347

SEQ ID NO: 11549 - protein, 656 aa, Escherichia coli DEC3C; identical to SEQ ID NO: 11390

SEQ ID NO: 11550 - protein, 207 aa, Escherichia coli DEC3C; identical to SEQ ID NO: 5743

SEQ ID NO: 11551 - protein, 113 aa, Escherichia coli DEC3C
MEKDQKNENTLQLAIISRIKMFYRPTNLAMAPEEAPAMLRFRRSGSNLTLINPTPYFITVTNMKAGNSNLPNTMVPPKGEVSVDIPHAATGDISFQTINDYGALTPRIKATMQ

SEQ ID NO: 11552 - protein, 871 aa, Escherichia coli DEC3C; identical to SEQ ID NO: 11363

SEQ ID NO: 11553 - protein, 366 aa, Escherichia coli DEC3C; identical to SEQ ID NO: 11362

SEQ ID NO: 11554 - protein, 700 aa, Escherichia coli DEC3C; identical to SEQ ID NO: 5740

SEQ ID NO: 11555 - protein, 539 aa, Escherichia coli DEC3C; identical to SEQ ID NO: 6525

SEQ ID NO: 11556 - protein, 405 aa, Escherichia coli DEC3C
MTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLQKAVNDAVANIPQPADGKSLTPDDVRPMLEQVVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 11557 - protein, 111 aa, Escherichia coli DEC3C; identical to SEQ ID NO: 5738

SEQ ID NO: 11558 - protein, 118 aa, Escherichia coli DEC3C [sequence omitted]

SEQ ID NO: 11559 - protein, 191 aa, Escherichia coli DEC3C; identical to SEQ ID NO: 5701

SEQ ID NO: 11560 - protein, 826 aa, Escherichia coli DEC3C; identical to SEQ ID NO: 11397

SEQ ID NO: 11561 - protein, 224 aa, Escherichia coli DEC3C; identical to SEQ ID NO: 11398

SEQ ID NO: 11562 - protein, 89 aa, Escherichia coli DEC3C; identical to SEQ ID NO: 6232

SEQ ID NO: 11563 - protein, 627 aa, Escherichia coli DEC3C; identical to SEQ ID NO: 11401

SEQ ID NO: 11564 - protein, 162 aa, Escherichia coli DEC3C; identical to SEQ ID NO: 5734

SEQ ID NO: 11565 - protein, 367 aa, Escherichia coli DEC3C; identical to SEQ ID NO: 5700

SEQ ID NO: 11566 - protein, 200 aa, Escherichia coli DEC3C; identical to SEQ ID NO: 5732

SEQ ID NO: 11567 - protein, 274 aa, Escherichia coli DEC3C; identical to SEQ ID NO: 5731

SEQ ID NO: 11568 - protein, 252 aa, Escherichia coli DEC3C; identical to SEQ ID NO: 11406

SEQ ID NO: 11569 - protein, 860 aa, Escherichia coli DEC3C; identical to SEQ ID NO: 11407

SEQ ID NO: 11570 - protein, 518 aa, Escherichia coli DEC3C; identical to SEQ ID NO: 11400

SEQ ID NO: 11571 - protein, 432 aa, Escherichia coli DEC3C; identical to SEQ ID NO: 5727

SEQ ID NO: 11572 - protein, 567 aa, Escherichia coli DEC3C; identical to SEQ ID NO: 11409

SEQ ID NO: 11573 - protein, 359 aa, Escherichia coli DEC3C; identical to SEQ ID NO: 11410

SEQ ID NO: 11574 - protein, 713 aa, Escherichia coli DEC3C; identical to SEQ ID NO: 11411

SEQ ID NO: 11575 - protein, 231 aa, Escherichia coli DEC3C; identical to SEQ ID NO: 5724

SEQ ID NO: 11576 - protein, 721 aa, Escherichia coli DEC3C
MDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYNFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 11577 - protein, 678 aa, Escherichia coli DEC3C; identical to SEQ ID NO: 5722

SEQ ID NO: 11578 - protein, 386 aa, Escherichia coli DEC3C; identical to SEQ ID NO: 11415

SEQ ID NO: 11579 - protein, 629 aa, Escherichia coli DEC3C; identical to SEQ ID NO: 11493

SEQ ID NO: 11580 - protein, 367 aa, Escherichia coli DEC3C; identical to SEQ ID NO: 11417

SEQ ID NO: 11581 - protein, 228 aa, Escherichia coli DEC3C; identical to SEQ ID NO: 11499

SEQ ID NO: 11582 - protein, 450 aa, Escherichia coli DEC3C
MNDDFSGEIKNEKPVKVLEKLSKLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQANISSSVISNASNFMIRVNALQQNSKAKILSQPSIITLNNMQAILDKNVTFYTKVSGEKVASLESITSGTLLRVTPRILDDSSNSLTGKRRERVRLLLDIQDGNQSTNQSNAQDASSTLPEVQNSEMTTEATLSAGESLLLGGFIQDKESSSKDGIPLLSDIPVIGSLFSSTVKQKHSVVRLFLIKATPIKSASSE

SEQ ID NO: 11583 - protein, 108 aa, Escherichia coli DEC3C
MATAGIVVGGTRVIFYGDKPDTTISIFNKETNLPYLLQTWVDPFNKEDKSKPPFSVIPPVSRIEPQQEKILRILKTAGELPKDRESVFWLNVKNIPPSIDKKIPMFLR

SEQ ID NO: 11584 - protein, 351 aa, Escherichia coli DEC3C; identical to SEQ ID NO: 5767

SEQ ID NO: 11585 - protein, 208 aa, Escherichia coli DEC3C; identical to SEQ ID NO: 5717

SEQ ID NO: 11586 - protein, 614 aa, Escherichia coli DEC3C; identical to SEQ ID NO: 5715

SEQ ID NO: 11587 - protein, 446 aa, Escherichia coli DEC3C; identical to SEQ ID NO: 5714

SEQ ID NO: 11588 - protein, 237 aa, Escherichia coli DEC3C; identical to SEQ ID NO: 5713

SEQ ID NO: 11589 - protein, 241 aa, Escherichia coli DEC3D; identical to SEQ ID NO: 11431

SEQ ID NO: 11590 - protein, 747 aa, Escherichia coli DEC3D; identical to SEQ ID NO: 5774

SEQ ID NO: 11591 - protein, 266 aa, Escherichia coli DEC3D; identical to SEQ ID NO: 5771

SEQ ID NO: 11592 - protein, 161 aa, Escherichia coli DEC3D; identical to SEQ ID NO: 5769

SEQ ID NO: 11593 - protein, 816 aa, Escherichia coli DEC3D; identical to SEQ ID NO: 11428

SEQ ID NO: 11594 - protein, 187 aa, Escherichia coli DEC3D
MNQSKNASLIQAWIDDGNTTIAPEKIQVTFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSHNDITLKNNHASEYELTVVDDYGNNIHSKIAAR

SEQ ID NO: 11595 - protein, 784 aa, Escherichia coli DEC3D; identical to SEQ ID NO: 5705

SEQ ID NO: 11596 - protein, 170 aa, Escherichia coli DEC3D; identical to SEQ ID NO: 5855

SEQ ID NO: 11597 - protein, 351 aa, Escherichia coli DEC3D; identical to SEQ ID NO: 5767

SEQ ID NO: 11598 - protein, 230 aa, Escherichia coli DEC3D; identical to SEQ ID NO: 5765

SEQ ID NO: 11599 - protein, 869 aa, Escherichia coli DEC3D; identical to SEQ ID NO: 5763

SEQ ID NO: 11600 - protein, 746 aa, Escherichia coli DEC3D; identical to SEQ ID NO: 5761

SEQ ID NO: 11601 - protein, 193 aa, Escherichia coli DEC3D; identical to SEQ ID NO: 5760

SEQ ID NO: 11602 - protein, 243 aa, Escherichia coli DEC3D; identical to SEQ ID NO: 11367

SEQ ID NO: 11603 - protein, 720 aa, Escherichia coli DEC3D; identical to SEQ ID NO: 11368

SEQ ID NO: 11604 - protein, 430 aa, Escherichia coli DEC3D; identical to SEQ ID NO: 5758

SEQ ID NO: 11605 - protein, 331 aa, Escherichia coli DEC3D; identical to SEQ ID NO: 6551

SEQ ID NO: 11606 - protein, 760 aa, Escherichia coli DEC3D; identical to SEQ ID NO: 5756

SEQ ID NO: 11607 - protein, 203 aa, Escherichia coli DEC3D; identical to SEQ ID NO: 6414

SEQ ID NO: 11608 - protein, 361 aa, Escherichia coli DEC3D; identical to SEQ ID NO: 11373

SEQ ID NO: 11609 - protein, 224 aa, Escherichia coli DEC3D; identical to SEQ ID NO: 11374

SEQ ID NO: 11610 - protein, 370 aa, Escherichia coli DEC3D; identical to SEQ ID NO: 11375

SEQ ID NO: 11611 - protein, 170 aa, Escherichia coli DEC3D; identical to SEQ ID NO: 11451

SEQ ID NO: 11612 - protein, 669 aa, Escherichia coli DEC3D; identical to SEQ ID NO: 8890

SEQ ID NO: 11613 - protein, 330 aa, Escherichia coli DEC3D
MASENPDEAGRYSMDVEYGQYSVILLVEGFPPSHAGTITVYEDSQPGTLNDFLGAMSEDDVRPEALRRFELMVEEAARHAEEAKKNAGEAETSARNAGISASQAEESAANADTSAGDASESARQAAESAAAAKQSEEASSSSASAAAQKASESSQSAAEAELSRKTAESAAGNAARDATTATEKARESAGSAQSAEQSRIAAEEAVNRIPTVVGPPGPKGEPGPAGPQGPKGDKGERGDTGPVGATGERGPAGDAGPAGPQGPKGDRGERGETGLTGNAGPQGPKGDTGAAGPAGPQGPKGETGAAGPVGATGPQGPKGDPGETQIRFRL

SEQ ID NO: 11614 - protein, 89 aa, Escherichia coli DEC3D; identical to SEQ ID NO: 6233

SEQ ID NO: 11615 - protein, 209 aa, Escherichia coli DEC3D; identical to SEQ ID NO: 11379

SEQ ID NO: 11616 - protein, 840 aa, Escherichia coli DEC3D; identical to SEQ ID NO: 11380

SEQ ID NO: 11617 - protein, 233 aa, Escherichia coli DEC3D; identical to SEQ ID NO: 11381

SEQ ID NO: 11618 - protein, 191 aa, Escherichia coli DEC3D; identical to SEQ ID NO: 5748

SEQ ID NO: 11619 - protein, 232 aa, Escherichia coli DEC3D; identical to SEQ ID NO: 5747

SEQ ID NO: 11620 - protein, 729 aa, Escherichia coli DEC3D; identical to SEQ ID NO: 5745

SEQ ID NO: 11621 - protein, 213 aa, Escherichia coli DEC3D; identical to SEQ ID NO: 5744

SEQ ID NO: 11622 - protein, 203 aa, Escherichia coli DEC3D; identical to SEQ ID NO: 6347

SEQ ID NO: 11623 - protein, 656 aa, Escherichia coli DEC3D; identical to SEQ ID NO: 11390

SEQ ID NO: 11624 - protein, 207 aa, Escherichia coli DEC3D; identical to SEQ ID NO: 5743

SEQ ID NO: 11625 - protein, 236 aa, Escherichia coli DEC3D; identical to SEQ ID NO: 11364

SEQ ID NO: 11626 - protein, 871 aa, Escherichia coli DEC3D; identical to SEQ ID NO: 11363

SEQ ID NO: 11627 - protein, 366 aa, Escherichia coli DEC3D; identical to SEQ ID NO: 11362

SEQ ID NO: 11628 - protein, 700 aa, Escherichia coli DEC3D; identical to SEQ ID NO: 5740

SEQ ID NO: 11629 - protein, 539 aa, Escherichia coli DEC3D; identical to SEQ ID NO: 6525

SEQ ID NO: 11630 - protein, 351 aa, Escherichia coli DEC3D
MTERELSIIRALGEEFSTVLADLQRTFEGKMAAQAQAFEEKLASLSAVLQKHVTVDEVHPVLQAMVDDAVGTIPVPRDGRDYDPDVLQQAVNDAVANIPVPADGKSITPDDVRPMLEQMVKEAVSHIPAPRDGRDYDPEVLKQAVNDAVANIPVPADGKSITPDDVRPMLEQMVKEAVSHIPVPRDGRDYDPDVLQKAVLDAVRALPAPQDGRDATALEIIPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 11631 - protein, 111 aa, Escherichia coli DEC3D; identical to SEQ ID NO: 5738

SEQ ID NO: 11632 - protein, 118 aa, Escherichia coli DEC3D [sequence omitted]

SEQ ID NO: 11633 - protein, 191 aa, Escherichia coli DEC3D; identical to SEQ ID NO: 5701

SEQ ID NO: 11634 - protein, 998 aa, Escherichia coli DEC3D; identical to SEQ ID NO: 6058

SEQ ID NO: 11635 - protein, 650 aa, Escherichia coli DEC3D; identical to SEQ ID NO: 11539

SEQ ID NO: 11636 - protein, 826 aa, Escherichia coli DEC3D; identical to SEQ ID NO: 11397

SEQ ID NO: 11637 - protein, 209 aa, Escherichia coli DEC3D
MKGLLSLLISSMIFPVHAGMVIFGTRIIYPAEQKEVMVQLMNQGNRSSLMQAWIDDGDTSLPPEKIQVPFMLTPPVVKVAANSGQQIKIKIMPNKLPSNKESIFYLNVLDIPPNSPEDEGKNALKFAMQNRIKLFYRPAGIAPVNKTTFKKLRVSRSGNNVVIKNDSPNWVTISDVKANNVKVNYETIMIAPQESQNVSEKIIMRMAGN

SEQ ID NO: 11638 - protein, 162 aa, Escherichia coli DEC3D; identical to SEQ ID NO: 5734

SEQ ID NO: 11639 - protein, 367 aa, Escherichia coli DEC3D; identical to SEQ ID NO: 5700

SEQ ID NO: 11640 - protein, 89 aa, Escherichia coli DEC3D; identical to SEQ ID NO: 6232

SEQ ID NO: 11641 - protein, 274 aa, Escherichia coli DEC3D; identical to SEQ ID NO: 5731

SEQ ID NO: 11642 - protein, 252 aa, Escherichia coli DEC3D; identical to SEQ ID NO: 11406

SEQ ID NO: 11643 - protein, 860 aa, Escherichia coli DEC3D; identical to SEQ ID NO: 11407

SEQ ID NO: 11644 - protein, 627 aa, Escherichia coli DEC3D; identical to SEQ ID NO: 11401

SEQ ID NO: 11645 - protein, 518 aa, Escherichia coli DEC3D; identical to SEQ ID NO: 11400

SEQ ID NO: 11646 - protein, 432 aa, Escherichia coli DEC3D; identical to SEQ ID NO: 5727

SEQ ID NO: 11647 - protein, 567 aa, Escherichia coli DEC3D; identical to SEQ ID NO: 11409

SEQ ID NO: 11648 - protein, 359 aa, Escherichia coli DEC3D; identical to SEQ ID NO: 11410

SEQ ID NO: 11649 - protein, 224 aa, Escherichia coli DEC3D
MIFTLLCSFCIGQALAGGIVLQRTRVIYDASRKEAALPVANKGAETPYLLQSWVDNIDGTSRAPFIITPPLIRLEAGDDSSLRIIKTADNLPENKESLFYINVRAIPAKKKSDDVNANELTLVFKTRIKMFYRPAHLKGRVSDAWKSLEFKRSDHSLNIYNPTEYYVVFAGLAVDKADLTSKIEYIAPGEHKQLPLPASGGKNVKWAAINDYGGSSGTETRPLQ

SEQ ID NO: 11650 - protein, 838 aa, Escherichia coli DEC3D; identical to SEQ ID NO: 5723

SEQ ID NO: 11651 - protein, 678 aa, Escherichia coli DEC3D; identical to SEQ ID NO: 5722

SEQ ID NO: 11652 - protein, 713 aa, Escherichia coli DEC3D; identical to SEQ ID NO: 11411

SEQ ID NO: 11653 - protein, 629 aa, Escherichia coli DEC3D; identical to SEQ ID NO: 11493

SEQ ID NO: 11654 - protein, 367 aa, Escherichia coli DEC3D; identical to SEQ ID NO: 11417

SEQ ID NO: 11655 - protein, 229 aa, Escherichia coli DEC3D; identical to SEQ ID NO: 11418

SEQ ID NO: 11656 - protein, 386 aa, Escherichia coli DEC3D; identical to SEQ ID NO: 11415

SEQ ID NO: 11657 - protein, 125 aa, Escherichia coli DEC3D; identical to SEQ ID NO: 11420

SEQ ID NO: 11658 - protein, 208 aa, Escherichia coli DEC3D; identical to SEQ ID NO: 5717

SEQ ID NO: 11659 - protein, 377 aa, Escherichia coli DEC3D
MRGYGYDNRTNYDAYYSPGSPLVDTRKLYSQSWDAGLRYNGELIKSQLITSYSHSKDYNYDPHYGRYDSSATLDEMKQYTVQWANNIIIGHGNVGAGVDWQKQSTAPGTAYVKDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 11660 - protein, 446 aa, Escherichia coli DEC3D; identical to SEQ ID NO: 5714

SEQ ID NO: 11661 - protein, 478 aa, Escherichia coli DEC3D; identical to SEQ ID NO: 5711

SEQ ID NO: 11662 - protein, 368 aa, Escherichia coli DEC3D; identical to SEQ ID NO: 11425

SEQ ID NO: 11663 - protein, 241 aa, Escherichia coli DEC3D; identical to SEQ ID NO: 5709

SEQ ID NO: 11664 - protein, 856 aa, Escherichia coli DEC3D
MAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLARNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 11665 - protein, 368 aa, Escherichia coli DEC3E; identical to SEQ ID NO: 11425

SEQ ID NO: 11666 - protein, 241 aa, Escherichia coli DEC3E; identical to SEQ ID NO: 5709

SEQ ID NO: 11667 - protein, 863 aa, Escherichia coli DEC3E; identical to SEQ ID NO: 11427

SEQ ID NO: 11668 - protein, 816 aa, Escherichia coli DEC3E; identical to SEQ ID NO: 11428

SEQ ID NO: 11669 - protein, 219 aa, Escherichia coli DEC3E; identical to SEQ ID NO: 11509

SEQ ID NO: 11670 - protein, 784 aa, Escherichia coli DEC3E; identical to SEQ ID NO: 5705

SEQ ID NO: 11671 - protein, 170 aa, Escherichia coli DEC3E; identical to SEQ ID NO: 5855

SEQ ID NO: 11672 - protein, 241 aa, Escherichia coli DEC3E; identical to SEQ ID NO: 11431

SEQ ID NO: 11673 - protein, 747 aa, Escherichia coli DEC3E; identical to SEQ ID NO: 5775

SEQ ID NO: 11674 - protein, 266 aa, Escherichia coli DEC3E; identical to SEQ ID NO: 5771

SEQ ID NO: 11675 - protein, 161 aa, Escherichia coli DEC3E; identical to SEQ ID NO: 5769

SEQ ID NO: 11676 - protein, 351 aa, Escherichia coli DEC3E
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGSSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 11677 - protein, 223 aa, Escherichia coli DEC3E
MMLIIFYLIISASVHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 11678 - protein, 869 aa, Escherichia coli DEC3E; identical to SEQ ID NO: 5763

SEQ ID NO: 11679 - protein, 746 aa, Escherichia coli DEC3E; identical to SEQ ID NO: 5761

SEQ ID NO: 11680 - protein, 193 aa, Escherichia coli DEC3E; identical to SEQ ID NO: 5760

SEQ ID NO: 11681 - protein, 243 aa, Escherichia coli DEC3E; identical to SEQ ID NO: 11367

SEQ ID NO: 11682 - protein, 816 aa, Escherichia coli DEC3E
MNIYRLSVLSCLAMVTPPALTAEFNLNVLDKSIRDSVDISLLNQKGVVAPGDYFVSVTVNNNKISNGQQIRWQKSGDKIIPCINESLIELFGLKSDFRKKLPAIKECVDFSVFPEIIFTFDQANQQLNITIPQAWLAWHSENWTPPSTWNNGIPGFLMDYNLFASTYRPQSGSSSNNLNAYGTTGLNAGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLAAGRPRSSMSHHTEDETFISHEVSWGMLSNTSLYGGMLLAGDDYRSGALGIGQNMLWMGALSFDVTWADSHFDTQQDEQGYSYRFNYSKQVDATNSTISLAAYRFSDRHFHSYANYIDHKYNDADAQDEKQTISLSFGQPITLLNLNLYANILHQSWWNADTSTTANITVGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGAAFHRRSSTNEPRLMVSTDGVGDIPIQGNIDYTNRFGIAVVPFVSSYQPTTVAVNMNDLPDGVTVSENVVKETWTEGAIGFKSLASRAGKDLNVIISDANGHFPPLGADVRQAEGGVSVGMVGENGHAWLSGVDENQQFTVHWGDQKTCAIHLPEHLEDVTKRLILPCH

SEQ ID NO: 11683 - protein, 430 aa, Escherichia coli DEC3E; identical to SEQ ID NO: 5758

SEQ ID NO: 11684 - protein, 331 aa, Escherichia coli DEC3E; identical to SEQ ID NO: 6551

SEQ ID NO: 11685 - protein, 760 aa, Escherichia coli DEC3E; identical to SEQ ID NO: 5756

SEQ ID NO: 11686 - protein, 669 aa, Escherichia coli DEC3E; identical to SEQ ID NO: 8890

SEQ ID NO: 11687 - protein, 203 aa, Escherichia coli DEC3E; identical to SEQ ID NO: 6414

SEQ ID NO: 11688 - protein, 361 aa, Escherichia coli DEC3E; identical to SEQ ID NO: 11373

SEQ ID NO: 11689 - protein, 224 aa, Escherichia coli DEC3E; identical to SEQ ID NO: 11374

SEQ ID NO: 11690 - protein, 630 aa, Escherichia coli DEC3E
MQRAVIPLKGELTVGDDYTAGDFFDSVSFRGVQLASDDNMLPDSLKGFAPVVRGIAKSNAQITIKQNGYTIYQTYVSPGAFEISDIYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLSEYGSFYLSGSQQTYWHTDQQDRLLQFGYNTQIKDLSLGISWNYSKSRGQPDADQVFALNFSLPLNLLLSRSNDSYTSKKNYAWMTSNTSIDNEGHTTQNLGLTETLLDDGNLSYSVQQGYNSEGKTANGSASMDYKGVFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGISLRFGAIATLDGVQTNSGIIDDDGSLYMAGLPAKGTITVRWGEAPDQICHISYELTEQQINSAITRMDAICR

SEQ ID NO: 11691 - protein, 446 aa, Escherichia coli DEC3E; identical to SEQ ID NO: 5714

SEQ ID NO: 11692 - protein, 209 aa, Escherichia coli DEC3E; identical to SEQ ID NO: 11379

SEQ ID NO: 11693 - protein, 840 aa, Escherichia coli DEC3E; identical to SEQ ID NO: 11380

SEQ ID NO: 11694 - protein, 233 aa, Escherichia coli DEC3E; identical to SEQ ID NO: 11381

SEQ ID NO: 11695 - protein, 191 aa, Escherichia coli DEC3E; identical to SEQ ID NO: 5748

SEQ ID NO: 11696 - protein, 232 aa, Escherichia coli DEC3E; identical to SEQ ID NO: 5747

SEQ ID NO: 11697 - protein, 729 aa, Escherichia coli DEC3E; identical to SEQ ID NO: 5745

SEQ ID NO: 11698 - protein, 213 aa, Escherichia coli DEC3E; identical to SEQ ID NO: 5744

SEQ ID NO: 11699 - protein, 203 aa, Escherichia coli DEC3E; identical to SEQ ID NO: 6347

SEQ ID NO: 11700 - protein, 656 aa, Escherichia coli DEC3E; identical to SEQ ID NO: 11390

SEQ ID NO: 11701 - protein, 207 aa, Escherichia coli DEC3E; identical to SEQ ID NO: 5743

SEQ ID NO: 11702 - protein, 650 aa, Escherichia coli DEC3E; identical to SEQ ID NO: 11539

SEQ ID NO: 11703 - protein, 236 aa, Escherichia coli DEC3E; identical to SEQ ID NO: 11364

SEQ ID NO: 11704 - protein, 366 aa, Escherichia coli DEC3E
MKLKIVAVVVTGLLAANVAHAAEVYNKDGNKLDLYGKVTALRYFTDDKRDDGDKTYARLGFKGETQINDQMIGFGHWEYDFKGYNDEANGSRDNKTRLAYAGLKISEFGSLDYGRNYGVGYDIGSWTDMLPEFGGDTWSQKDVFMTYRTTGVATYRNYDFFGLIEGLNFAAQYQGKNERTDNSHLYGADYTRANGDGFGISSTYVYDGFGIGAVYTKSDRTNAQERAAANPLNASGKNAELWATGIKYDANNIYFAANYAETLNMTTYGDGYISNKAQNFEVVAQYQFDFGLRPSLAYLKSKGIDLGRYGDQDMIEYIDVGATYFFNKNMSTYVDYKINLIDESDFTRAVDIRTDNIVATGITYQF

SEQ ID NO: 11705 - protein, 700 aa, Escherichia coli DEC3E; identical to SEQ ID NO: 5740

SEQ ID NO: 11706 - protein, 539 aa, Escherichia coli DEC3E; identical to SEQ ID NO: 6525

SEQ ID NO: 11707 - protein, 102 aa, Escherichia coli DEC3E
MKKVLALVVAAAMGLSSAAFAAETATTPAPTATTTKAAPAKTTHHKKQHKAAPAQKAQAAKKHHKNTKAEQKAPEQKAQAAKKHAKKHSHQQPAKPAAQPAA

SEQ ID NO: 11708 - protein, 118 aa, Escherichia coli DEC3E [sequence omitted]

SEQ ID NO: 11709 - protein, 191 aa, Escherichia coli DEC3E; identical to SEQ ID NO: 5701

SEQ ID NO: 11710 - protein, 715 aa, Escherichia coli DEC3E
MLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 11711 - protein, 89 aa, Escherichia coli DEC3E; identical to SEQ ID NO: 6053

SEQ ID NO: 11712 - protein, 826 aa, Escherichia coli DEC3E; identical to SEQ ID NO: 11397

SEQ ID NO: 11713 - protein, 224 aa, Escherichia coli DEC3E; identical to SEQ ID NO: 11398

SEQ ID NO: 11714 - protein, 637 aa, Escherichia coli DEC3E; identical to SEQ ID NO: 11485

SEQ ID NO: 11715 - protein, 162 aa, Escherichia coli DEC3E; identical to SEQ ID NO: 5734

SEQ ID NO: 11716 - protein, 367 aa, Escherichia coli DEC3E; identical to SEQ ID NO: 5700

SEQ ID NO: 11717 - protein, 200 aa, Escherichia coli DEC3E; identical to SEQ ID NO: 5732

SEQ ID NO: 11718 - protein, 274 aa, Escherichia coli DEC3E; identical to SEQ ID NO: 5731

SEQ ID NO: 11719 - protein, 252 aa, Escherichia coli DEC3E; identical to SEQ ID NO: 11406

SEQ ID NO: 11720 - protein, 860 aa, Escherichia coli DEC3E
MSGSYVNAWAENEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDITHSHTRLDKETAYGKGSLDGNSFRLSYSKDFDELNSRVTFAGYRFSEENFMTMSEYLDASDSEMVRTGNDKEMYTATYNQNFRDAGVSVYLNYTRHTYWDRDEQTNYNVMLSHYFNLGSIRNMSISMTGYRYEYDNQADKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQATLTEGAIGYRKFSVISGQKAMAVLRLQDGSYPPFGAEVKNDSAQNVGLVDDDGNVYLAGVKPGEHMIVSWGGVAHCDIHLPDPLPADLFNGLLLPCQQTGAISPSMPHEIKPVIQEQTQQVMPTEAPVSVSAN

SEQ ID NO: 11721 - protein, 518 aa, Escherichia coli DEC3E; identical to SEQ ID NO: 11400

SEQ ID NO: 11722 - protein, 998 aa, Escherichia coli DEC3E; identical to SEQ ID NO: 5657

SEQ ID NO: 11723 - protein, 432 aa, Escherichia coli DEC3E; identical to SEQ ID NO: 5727

SEQ ID NO: 11724 - protein, 567 aa, Escherichia coli DEC3E; identical to SEQ ID NO: 11409

SEQ ID NO: 11725 - protein, 359 aa, Escherichia coli DEC3E; identical to SEQ ID NO: 11410

SEQ ID NO: 11726 - protein, 713 aa, Escherichia coli DEC3E
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 11727 - protein, 224 aa, Escherichia coli DEC3E; identical to SEQ ID NO: 11649

SEQ ID NO: 11728 - protein, 838 aa, Escherichia coli DEC3E
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYNFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLEHWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 11729 - protein, 678 aa, Escherichia coli DEC3E; identical to SEQ ID NO: 5722

SEQ ID NO: 11730 - protein, 386 aa, Escherichia coli DEC3E; identical to SEQ ID NO: 11415

SEQ ID NO: 11731 - protein, 660 aa, Escherichia coli DEC3E
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 11732 - protein, 324 aa, Escherichia coli DEC3E; identical to SEQ ID NO: 11498

SEQ ID NO: 11733 - protein, 229 aa, Escherichia coli DEC3E; identical to SEQ ID NO: 11418

SEQ ID NO: 11734 - protein, 512 aa, Escherichia coli DEC3E; identical to SEQ ID NO: 5948

SEQ ID NO: 11735 - protein, 108 aa, Escherichia coli DEC3E; identical to SEQ ID NO: 11583

SEQ ID NO: 11736 - protein, 208 aa, Escherichia coli DEC3E; identical to SEQ ID NO: 5717

SEQ ID NO: 11737 - protein, 237 aa, Escherichia coli DEC3E; identical to SEQ ID NO: 5713

SEQ ID NO: 11738 - protein, 478 aa, Escherichia coli DEC3E; identical to SEQ ID NO: 5711

SEQ ID NO: 11739 - protein, 614 aa, Escherichia coli DEC3E; identical to SEQ ID NO: 5715

SEQ ID NO: 11740 - protein, 998 aa, Escherichia coli DEC3F; identical to SEQ ID NO: 6058

SEQ ID NO: 11741 - protein, 835 aa, Escherichia coli DEC3F; identical to SEQ ID NO: 6234

SEQ ID NO: 11742 - protein, 243 aa, Escherichia coli DEC3F; identical to SEQ ID NO: 6236

SEQ ID NO: 11743 - protein, 368 aa, Escherichia coli DEC3F; identical to SEQ ID NO: 11425

SEQ ID NO: 11744 - protein, 241 aa, Escherichia coli DEC3F; identical to SEQ ID NO: 5709

SEQ ID NO: 11745 - protein, 856 aa, Escherichia coli DEC3F
MAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 11746 - protein, 816 aa, Escherichia coli DEC3F; identical to SEQ ID NO: 11428

SEQ ID NO: 11747 - protein, 227 aa, Escherichia coli DEC3F; identical to SEQ ID NO: 11429

SEQ ID NO: 11748 - protein, 170 aa, Escherichia coli DEC3F; identical to SEQ ID NO: 5855

SEQ ID NO: 11749 - protein, 241 aa, Escherichia coli DEC3F; identical to SEQ ID NO: 11431

SEQ ID NO: 11750 - protein, 747 aa, Escherichia coli DEC3F; identical to SEQ ID NO: 5773

SEQ ID NO: 11751 - protein, 266 aa, Escherichia coli DEC3F; identical to SEQ ID NO: 5770

SEQ ID NO: 11752 - protein, 161 aa, Escherichia coli DEC3F; identical to SEQ ID NO: 5769

SEQ ID NO: 11753 - protein, 351 aa, Escherichia coli DEC3F; identical to SEQ ID NO: 5767

SEQ ID NO: 11754 - protein, 230 aa, Escherichia coli DEC3F; identical to SEQ ID NO: 5765

SEQ ID NO: 11755 - protein, 869 aa, Escherichia coli DEC3F; identical to SEQ ID NO: 5762

SEQ ID NO: 11756 - protein, 746 aa, Escherichia coli DEC3F; identical to SEQ ID NO: 5761

SEQ ID NO: 11757 - protein, 193 aa, Escherichia coli DEC3F; identical to SEQ ID NO: 5760

SEQ ID NO: 11758 - protein, 430 aa, Escherichia coli DEC3F; identical to SEQ ID NO: 5758

SEQ ID NO: 11759 - protein, 331 aa, Escherichia coli DEC3F; identical to SEQ ID NO: 6551

SEQ ID NO: 11760 - protein, 760 aa, Escherichia coli DEC3F; identical to SEQ ID NO: 5756

SEQ ID NO: 11761 - protein, 203 aa, Escherichia coli DEC3F; identical to SEQ ID NO: 6414

SEQ ID NO: 11762 - protein, 361 aa, Escherichia coli DEC3F; identical to SEQ ID NO: 11373

SEQ ID NO: 11763 - protein, 224 aa, Escherichia coli DEC3F; identical to SEQ ID NO: 11374

SEQ ID NO: 11764 - protein, 630 aa, Escherichia coli DEC3F
MQRAVIPLKGELTVGDDYTAGDFFDSVSFRGVQLASDDNMLPDSLKGFAPVVRGIAKSNAQITIKQNGYTIYQTYVSPGAFEISDIYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLSEYGSFYLSGSQQTYWHTDQQDRLLQFGYNTQIKDLSLGISWNYSKSRGQPDADQVFALNFSLPLNLLLSRSNDSYTSKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGISLRFGAIATLDGVQTNSGIIDDDGSLYMAGLPAKGTITVRWGEAPDQICHISYELTEQQINSAITRMDAICR

SEQ ID NO: 11765 - protein, 229 aa, Escherichia coli DEC3F
MALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKMAMRSVFKLFWRPEGLPGDPLEAYQQLRWTRKSQGVQLTNPTPYYINLIQVSVNGKALSNVGVVPPKSQRQTSWCQAIAPCHVAWRAINDYGGLSAKKEQNLP

SEQ ID NO: 11766 - protein, 209 aa, Escherichia coli DEC3F; identical to SEQ ID NO: 11379

SEQ ID NO: 11767 - protein, 840 aa, Escherichia coli DEC3F
MNKSVVSISAAMLVLLCQPVMGSEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAKELAPGITSQTQLSQLRLDLSVPQSQLISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWPHSTDGSSQLQSSLTGMLDEAQTTNYSLNVMRDQQYKQTTLSGNMQKRFSQTTVGLNASKGQDYWQASGNVQGAMAVHGGGITFGPYLGETFALVEAKGAEGAKVYNSSQLEINDSGYALVPAVTPYRYNRISLDPQGMDGDAELVDSERQVAPVAGAAVKVIFRTRPGKALLIKSRMADGSELPMGADVLDENNTVVGIAGQGGQIYLRTEQTKGHLSVRWGEGANDSCQLPFDISGKDSNSPIIRLNETCQS

SEQ ID NO: 11768 - protein, 233 aa, Escherichia coli DEC3F; identical to SEQ ID NO: 11381

SEQ ID NO: 11769 - protein, 191 aa, Escherichia coli DEC3F; identical to SEQ ID NO: 5748

SEQ ID NO: 11770 - protein, 232 aa, Escherichia coli DEC3F; identical to SEQ ID NO: 5746

SEQ ID NO: 11771 - protein, 729 aa, Escherichia coli DEC3F; identical to SEQ ID NO: 5745

SEQ ID NO: 11772 - protein, 213 aa, Escherichia coli DEC3F; identical to SEQ ID NO: 5744

SEQ ID NO: 11773 - protein, 203 aa, Escherichia coli DEC3F; identical to SEQ ID NO: 6347

SEQ ID NO: 11774 - protein, 656 aa, Escherichia coli DEC3F
MRLKKHYLCTALSLAFTQQAVAAQESDSLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSELGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFVNEDTLALSYYDRKRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFIEEGRNFWAGVEYTF

SEQ ID NO: 11775 - protein, 207 aa, Escherichia coli DEC3F; identical to SEQ ID NO: 5743

SEQ ID NO: 11776 - protein, 446 aa, Escherichia coli DEC3F; identical to SEQ ID NO: 5714

SEQ ID NO: 11777 - protein, 236 aa, Escherichia coli DEC3F; identical to SEQ ID NO: 11364

SEQ ID NO: 11778 - protein, 366 aa, Escherichia coli DEC3F; identical to SEQ ID NO: 11362

SEQ ID NO: 11779 - protein, 700 aa, Escherichia coli DEC3F; identical to SEQ ID NO: 5740

SEQ ID NO: 11780 - protein, 539 aa, Escherichia coli DEC3F; identical to SEQ ID NO: 6525

SEQ ID NO: 11781 - protein, 111 aa, Escherichia coli DEC3F; identical to SEQ ID NO: 5738

SEQ ID NO: 11782 - protein, 118 aa, Escherichia coli DEC3F [sequence omitted]

SEQ ID NO: 11783 - protein, 89 aa, Escherichia coli DEC3F; identical to SEQ ID NO: 6233

SEQ ID NO: 11784 - protein, 397 aa, Escherichia coli DEC3F
MKRKVLAMLVPALLVAGAANAAEIYNKDGNKLDLYGKVAGLHYFSDDASSDGDMSYARIGFKGETQIADQFTGYGQWEFNIGANGPESDKGNTATRLAFAGFGFGQNGTFDYGRNYGVVYDVEAWTDMLPEFGGDTYAGADNFMNGRANSVATYRNNGFFGQVDGLNFALQYQGNNEKSGLFDQEGSGNGNGRKLAKENGDGYGMSTSYDFDFDFGLSLGAAYSNSDRTDNQVHKGTHNTRYGDRFDATAGGETAEAWTVGAKYDANNVYLAAMYAEPRNMTGYGDADAIANKTQNFEVVAQYQFDFGLRPSIAYLQSKGKDLGGVNSDNFDSQGNHHYTNKDLVKYVDIGMTYYFNKNMSTYVDYKINLLDNDDDFYKENGIATDDIVAVGLVYQF

SEQ ID NO: 11785 - protein, 826 aa, Escherichia coli DEC3F
MLRMTPLASAIVALLLGIEAHAAEETFDTHFMMGGMKGEQVTNLRLDDNQPLPGQYDIDIYVNKQWRGKYEIIVKDNPHETCLTREIVKRLGINSDNFARENQCLTFEQLVQDGSYSWDIGIFRLDLAVPQAWVEELENGYVPPENWERGINAFYTSYYVSQYYSDYKASGNSKSTYVRFNSGLNLLGWQLHSDASFSKTDNNPGEWKSNTLYLEHGFSQILGTLRIGDMYTSADIFDSVRFTGVRLFRDMQMLPNSKQNFTPRVQGIAQSNALVTIEQNGFVVYQKEVPPGPFSISDLQLAGGGADLDVSVKEADGSVTTYLVPYAAVPNMLQPGVSKYDFAAGRSHIEGASKQSDFVQAGYQYGFNNLLTLYGGTMVANNYYAFTLGTGWNTRIGAISVDATKSHSKQDNGDVFDGQSYQIAYNKFLSQTSTRFGLAAWRYSSRDYRTFNDYVWANNKDNYRRDKNDVYDIADYYQNDFGRKNSFSANMSQSLPEGWGSVSLSTLWRDYWGRSGSSKDYQLSYSNNWRRISYTLAASQAYDENHAEEKRFNIFISIPFDWGDDVTTPRRQIYMSNSTTFDDQGFASNNTGLSGTVGNRDQFNYGINLSHQHQGNETTAGANLTWTAPAATVNGSYSQSSTYRQVGASVSGGLVAWSGGVNLANRLSETFAVMHAPGIKDAYVNGQKYRTTNCNGVVVYDGLTPYRENHLMMDVSQSDSETELRGNRKMTAPYRGAVVLVDFDTDQRKPWFIKALRSDGQPLTFGYEVNDMHGHNIGVVGQGSQIFIRTNEIPPAVNVAIDKQQGLSCTITFGKEIDESKNYICR

SEQ ID NO: 11786 - protein, 209 aa, Escherichia coli DEC3F
MKGLLSLLISSMIFPVHAGMVIFGTRIIYPAEQKEVMVQLMNQGNRSSLMQAWIDDGDTSLPPEKIQVPFMLTPPVVKVAANSGQQIKIKIMPNKLPSNKESIFYLNVLDIPPNSPEDEGKNALKFAMQNRIKLFYRPAGIAPVNKTTFKKLRVSRSGNNVVIKNDSPNWVTISDVKANNVKVNYETIMIAPQESQNVCVKIIMRMAGN

SEQ ID NO: 11787 - protein, 627 aa, Escherichia coli DEC3F; identical to SEQ ID NO: 11401

SEQ ID NO: 11788 - protein, 162 aa, Escherichia coli DEC3F; identical to SEQ ID NO: 5734

SEQ ID NO: 11789 - protein, 367 aa, Escherichia coli DEC3F; identical to SEQ ID NO: 5700

SEQ ID NO: 11790 - protein, 200 aa, Escherichia coli DEC3F; identical to SEQ ID NO: 5732

SEQ ID NO: 11791 - protein, 274 aa, Escherichia coli DEC3F; identical to SEQ ID NO: 5730

SEQ ID NO: 11792 - protein, 252 aa, Escherichia coli DEC3F; identical to SEQ ID NO: 11406

SEQ ID NO: 11793 - protein, 518 aa, Escherichia coli DEC3F; identical to SEQ ID NO: 11400

SEQ ID NO: 11794 - protein, 132 aa, Escherichia coli DEC3F; identical to SEQ ID NO: 6057

SEQ ID NO: 11795 - protein, 432 aa, Escherichia coli DEC3F; identical to SEQ ID NO: 5727

SEQ ID NO: 11796 - protein, 567 aa, Escherichia coli DEC3F; identical to SEQ ID NO: 11409

SEQ ID NO: 11797 - protein, 359 aa, Escherichia coli DEC3F; identical to SEQ ID NO: 11410

SEQ ID NO: 11798 - protein, 689 aa, Escherichia coli DEC3F
MIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 11799 - protein, 231 aa, Escherichia coli DEC3F; identical to SEQ ID NO: 5724

SEQ ID NO: 11800 - protein, 721 aa, Escherichia coli DEC3F; identical to SEQ ID NO: 11576

SEQ ID NO: 11801 - protein, 678 aa, Escherichia coli DEC3F; identical to SEQ ID NO: 5721

SEQ ID NO: 11802 - protein, 386 aa, Escherichia coli DEC3F
MVDDVPVAQVLQALAEQEKLNLVVSPDVSGTVSLHLTDVPWKQALQTVVKSAGLITRQEGNILSVHSIAWQNDNIARQEAEQARAQANLPLENRNITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLALELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 11803 - protein, 660 aa, Escherichia coli DEC3F; identical to SEQ ID NO: 11731

SEQ ID NO: 11804 - protein, 367 aa, Escherichia coli DEC3F; identical to SEQ ID NO: 11417

SEQ ID NO: 11805 - protein, 143 aa, Escherichia coli DEC3F
MRIVNITPGLPQDRESVYWVNVKAIPSKSDDSENKNVLQIAVRTRIKLFYRPAGLKGDVKTAPNELRFTRNGNQLRVDNPTVFNITFNQFFANDKEIEKAGMVPAKGALNITLPAGVGSVSKIKYNTINDFGSSAEMITKNVD

SEQ ID NO: 11806 - protein, 512 aa, Escherichia coli DEC3F; identical to SEQ ID NO: 5948

SEQ ID NO: 11807 - protein, 108 aa, Escherichia coli DEC3F; identical to SEQ ID NO: 11583

SEQ ID NO: 11808 - protein, 208 aa, Escherichia coli DEC3F; identical to SEQ ID NO: 5717

SEQ ID NO: 11809 - protein, 243 aa, Escherichia coli DEC3F; identical to SEQ ID NO: 8524

SEQ ID NO: 11810 - protein, 816 aa, Escherichia coli DEC3F
MNIYRLSVLSCLAMVTPPALTAEFNLNVLDKSIRDSVDISLLNQKGVVAPGDYFVSVTVNNNKISNGQQIRWQKSGDKIIPCINESLIELFGLKSDFRKKLPAIKECVDFSVFPEIIFTFDQANQQLNITIPQAWLAWHSENWTPPSTWNNGIPGFLMDYNLFASTYRPQSGSSSNNLNAYGTTGLNAGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLAAGRPRSSMSHHTEDETFISHEVSWGMLSNTSPYGGMLLAGDDYRSGALGIGQNMLWMGALSFDVTWADSHFDTQQDEQGYSYRFNYSKQVDATNSTISLAAYRFSDRHFHSYANYIDHKYNDADAQDEKQTISLSFGQPITLLNLNLYANILHQSWWNADTSTTANITVGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGAAFHRRSSTNEPRLMVSTDGVGDIPIQGNIDYTNRFGIAVVPFVSSYQPTTVAVNMNDLPDGVTVSENVVKETWTEGAIGFKSLASRAGKDLNVIISDANGHFPPLGADVRQAEGGVSVGMVGENGHAWLSGVDENQQFTVHWGDQKTCAIHLPEHLEDVTKRLILPCH

SEQ ID NO: 11811 - protein, 614 aa, Escherichia coli DEC3F; identical to SEQ ID NO: 5716

SEQ ID NO: 11812 - protein, 237 aa, Escherichia coli DEC3F; identical to SEQ ID NO: 5713

SEQ ID NO: 11813 - protein, 747 aa, Escherichia coli DEC4A; identical to SEQ ID NO: 5775

SEQ ID NO: 11814 - protein, 266 aa, Escherichia coli DEC4A; identical to SEQ ID NO: 5771

SEQ ID NO: 11815 - protein, 161 aa, Escherichia coli DEC4A; identical to SEQ ID NO: 5769

SEQ ID NO: 11816 - protein, 351 aa, Escherichia coli DEC4A; identical to SEQ ID NO: 5767

SEQ ID NO: 11817 - protein, 230 aa, Escherichia coli DEC4A; identical to SEQ ID NO: 5765

SEQ ID NO: 11818 - protein, 869 aa, Escherichia coli DEC4A; identical to SEQ ID NO: 5763

SEQ ID NO: 11819 - protein, 746 aa, Escherichia coli DEC4A; identical to SEQ ID NO: 5761

SEQ ID NO: 11820 - protein, 193 aa, Escherichia coli DEC4A; identical to SEQ ID NO: 5760

SEQ ID NO: 11821 - protein, 222 aa, Escherichia coli DEC4A
MQPDRTRIIFNSKDKATSLRVENRSDKLPYLAYSWIENEKGEKSDEFLVALPPIQRLEPKATSQVRIMKQAATAKLPTDRESLFYYNLREIPPVPEGSEGHAILQVAVQSRIKLFWRPAALRKKMGDHVEQQLQVSQQNNQLTLKTPTGYYLTIAYLGRDEKGVLPGFKSTMVAPFSSVTTSTGSYSGKQFYLGYMDDYGALRMNTLSCQRQCRLQPVENKK

SEQ ID NO: 11822 - protein, 816 aa, Escherichia coli DEC4A; identical to SEQ ID NO: 11682

SEQ ID NO: 11823 - protein, 203 aa, Escherichia coli DEC4A; identical to SEQ ID NO: 6414

SEQ ID NO: 11824 - protein, 361 aa, Escherichia coli DEC4A; identical to SEQ ID NO: 11373

SEQ ID NO: 11825 - protein, 224 aa, Escherichia coli DEC4A; identical to SEQ ID NO: 11374

SEQ ID NO: 11826 - protein, 370 aa, Escherichia coli DEC4A; identical to SEQ ID NO: 11375

SEQ ID NO: 11827 - protein, 170 aa, Escherichia coli DEC4A; identical to SEQ ID NO: 11451

SEQ ID NO: 11828 - protein, 430 aa, Escherichia coli DEC4A; identical to SEQ ID NO: 5758

SEQ ID NO: 11829 - protein, 331 aa, Escherichia coli DEC4A; identical to SEQ ID NO: 6551

SEQ ID NO: 11830 - protein, 760 aa, Escherichia coli DEC4A; identical to SEQ ID NO: 5756

SEQ ID NO: 11831 - protein, 229 aa, Escherichia coli DEC4A; identical to SEQ ID NO: 11455

SEQ ID NO: 11832 - protein, 840 aa, Escherichia coli DEC4A; identical to SEQ ID NO: 11380

SEQ ID NO: 11833 - protein, 233 aa, Escherichia coli DEC4A; identical to SEQ ID NO: 11381

SEQ ID NO: 11834 - protein, 669 aa, Escherichia coli DEC4A; identical to SEQ ID NO: 8890

SEQ ID NO: 11835 - protein, 213 aa, Escherichia coli DEC4A; identical to SEQ ID NO: 5744

SEQ ID NO: 11836 - protein, 191 aa, Escherichia coli DEC4A; identical to SEQ ID NO: 5748

SEQ ID NO: 11837 - protein, 232 aa, Escherichia coli DEC4A; identical to SEQ ID NO: 5747

SEQ ID NO: 11838 - protein, 729 aa, Escherichia coli DEC4A; identical to SEQ ID NO: 5745

SEQ ID NO: 11839 - protein, 203 aa, Escherichia coli DEC4A; identical to SEQ ID NO: 6347

SEQ ID NO: 11840 - protein, 322 aa, Escherichia coli DEC4A
MRENDLLTFAVNWKDDVHREKGAPHAAYDRYEDRTWSLASEYQWAAADNVDVVAGISYDWRDSVEAKKHEKDGSITHYDDNNQSAFNWQVMGKYHFVNEDTLALSYYDRKRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFVEEGRNFWAGVEYTF

SEQ ID NO: 11841 - protein, 446 aa, Escherichia coli DEC4A; identical to SEQ ID NO: 5714

SEQ ID NO: 11842 - protein, 236 aa, Escherichia coli DEC4A; identical to SEQ ID NO: 11364

SEQ ID NO: 11843 - protein, 366 aa, Escherichia coli DEC4A; identical to SEQ ID NO: 11362

SEQ ID NO: 11844 - protein, 700 aa, Escherichia coli DEC4A; identical to SEQ ID NO: 5740

SEQ ID NO: 11845 - protein, 539 aa, Escherichia coli DEC4A; identical to SEQ ID NO: 6525

SEQ ID NO: 11846 - protein, 655 aa, Escherichia coli DEC4A; identical to SEQ ID NO: 11466

SEQ ID NO: 11847 - protein, 998 aa, Escherichia coli DEC4A; identical to SEQ ID NO: 6058

SEQ ID NO: 11848 - protein, 111 aa, Escherichia coli DEC4A; identical to SEQ ID NO: 5738

SEQ ID NO: 11849 - protein, 118 aa, Escherichia coli DEC4A [sequence omitted]

SEQ ID NO: 11850 - protein, 191 aa, Escherichia coli DEC4A; identical to SEQ ID NO: 5701

SEQ ID NO: 11851 - protein, 715 aa, Escherichia coli DEC4A; identical to SEQ ID NO: 11710

SEQ ID NO: 11852 - protein, 826 aa, Escherichia coli DEC4A; identical to SEQ ID NO: 11397

SEQ ID NO: 11853 - protein, 224 aa, Escherichia coli DEC4A; identical to SEQ ID NO: 11398

SEQ ID NO: 11854 - protein, 200 aa, Escherichia coli DEC4A; identical to SEQ ID NO: 5732

SEQ ID NO: 11855 - protein, 518 aa, Escherichia coli DEC4A; identical to SEQ ID NO: 11400

SEQ ID NO: 11856 - protein, 627 aa, Escherichia coli DEC4A; identical to SEQ ID NO: 11401

SEQ ID NO: 11857 - protein, 274 aa, Escherichia coli DEC4A; identical to SEQ ID NO: 5731

SEQ ID NO: 11858 - protein, 252 aa, Escherichia coli DEC4A; identical to SEQ ID NO: 11406

SEQ ID NO: 11859 - protein, 860 aa, Escherichia coli DEC4A; identical to SEQ ID NO: 11720

SEQ ID NO: 11860 - protein, 162 aa, Escherichia coli DEC4A; identical to SEQ ID NO: 5734

SEQ ID NO: 11861 - protein, 311 aa, Escherichia coli DEC4A
MRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 11862 - protein, 432 aa, Escherichia coli DEC4A; identical to SEQ ID NO: 5727

SEQ ID NO: 11863 - protein, 359 aa, Escherichia coli DEC4A; identical to SEQ ID NO: 11410

SEQ ID NO: 11864 - protein, 215 aa, Escherichia coli DEC4A
MPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 11865 - protein, 224 aa, Escherichia coli DEC4A; identical to SEQ ID NO: 11649

SEQ ID NO: 11866 - protein, 721 aa, Escherichia coli DEC4A; identical to SEQ ID NO: 11576

SEQ ID NO: 11867 - protein, 678 aa, Escherichia coli DEC4A; identical to SEQ ID NO: 5722

SEQ ID NO: 11868 - protein, 367 aa, Escherichia coli DEC4A; identical to SEQ ID NO: 11417

SEQ ID NO: 11869 - protein, 229 aa, Escherichia coli DEC4A; identical to SEQ ID NO: 11418

SEQ ID NO: 11870 - protein, 660 aa, Escherichia coli DEC4A; identical to SEQ ID NO: 11731

SEQ ID NO: 11871 - protein, 386 aa, Escherichia coli DEC4A; identical to SEQ ID NO: 11415

SEQ ID NO: 11872 - protein, 514 aa, Escherichia coli DEC4A
MCNEKNKFFYFTALFCCSAQAAPSSLEKRLGKSEYFIITKSSPVRAILNDFAANYSIPVFISSSVNDDFSGEIKNEKPVKVLEKLSKLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQANISSSVISNASNFMIRVNALQQNSKAKILSQPSIITLNNMQAILDKNVTFYTKVSGEKVASLESITSGTLLRVTPRILDDSSNSLTGKRRERVRLLLDIQDGNQSTNQSNAQDASSTLPEVQNSEMTTEATLSAGESLLLGGFIQDKESSSKDGIPLLSDIPVIGSLFSSTVKQKHSVVRLFLIKATPIKSASSE

SEQ ID NO: 11873 - protein, 108 aa, Escherichia coli DEC4A; identical to SEQ ID NO: 11583

SEQ ID NO: 11874 - protein, 208 aa, Escherichia coli DEC4A; identical to SEQ ID NO: 5717

SEQ ID NO: 11875 - protein, 468 aa, Escherichia coli DEC4A
MNIITTRDEPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGSPLVDTRKLYSQSWDAGLRYNGELIKSQLITSYSHSKDYNYDPHYGRYDSSATLDEMKQYTVQWANNIIIGHGNVGAGVDWQKQSTAPGTAYVKDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 11876 - protein, 237 aa, Escherichia coli DEC4A; identical to SEQ ID NO: 5713

SEQ ID NO: 11877 - protein, 478 aa, Escherichia coli DEC4A; identical to SEQ ID NO: 5711

SEQ ID NO: 11878 - protein, 368 aa, Escherichia coli DEC4A; identical to SEQ ID NO: 11425

SEQ ID NO: 11879 - protein, 241 aa, Escherichia coli DEC4A; identical to SEQ ID NO: 11431

SEQ ID NO: 11880 - protein, 241 aa, Escherichia coli DEC4A; identical to SEQ ID NO: 5709

SEQ ID NO: 11881 - protein, 878 aa, Escherichia coli DEC4A; identical to SEQ ID NO: 5707

SEQ ID NO: 11882 - protein, 227 aa, Escherichia coli DEC4A; identical to SEQ ID NO: 11429

SEQ ID NO: 11883 - protein, 784 aa, Escherichia coli DEC4A; identical to SEQ ID NO: 5705

SEQ ID NO: 11884 - protein, 170 aa, Escherichia coli DEC4A; identical to SEQ ID NO: 5855

SEQ ID NO: 11885 - protein, 161 aa, Escherichia coli DEC4B; identical to SEQ ID NO: 5769

SEQ ID NO: 11886 - protein, 747 aa, Escherichia coli DEC4B; identical to SEQ ID NO: 5775

SEQ ID NO: 11887 - protein, 266 aa, Escherichia coli DEC4B; identical to SEQ ID NO: 5771

SEQ ID NO: 11888 - protein, 351 aa, Escherichia coli DEC4B; identical to SEQ ID NO: 5767

SEQ ID NO: 11889 - protein, 746 aa, Escherichia coli DEC4B; identical to SEQ ID NO: 5761

SEQ ID NO: 11890 - protein, 193 aa, Escherichia coli DEC4B; identical to SEQ ID NO: 5760

SEQ ID NO: 11891 - protein, 230 aa, Escherichia coli DEC4B; identical to SEQ ID NO: 5765

SEQ ID NO: 11892 - protein, 780 aa, Escherichia coli DEC4B; identical to SEQ ID NO: 11360

SEQ ID NO: 11893 - protein, 243 aa, Escherichia coli DEC4B; identical to SEQ ID NO: 11367

SEQ ID NO: 11894 - protein, 816 aa, Escherichia coli DEC4B; identical to SEQ ID NO: 11682

SEQ ID NO: 11895 - protein, 430 aa, Escherichia coli DEC4B; identical to SEQ ID NO: 5758

SEQ ID NO: 11896 - protein, 331 aa, Escherichia coli DEC4B; identical to SEQ ID NO: 6551

SEQ ID NO: 11897 - protein, 760 aa, Escherichia coli DEC4B; identical to SEQ ID NO: 5756

SEQ ID NO: 11898 - protein, 361 aa, Escherichia coli DEC4B; identical to SEQ ID NO: 11373

SEQ ID NO: 11899 - protein, 224 aa, Escherichia coli DEC4B; identical to SEQ ID NO: 11374

SEQ ID NO: 11900 - protein, 370 aa, Escherichia coli DEC4B; identical to SEQ ID NO: 11375

SEQ ID NO: 11901 - protein, 170 aa, Escherichia coli DEC4B
MIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGCRATRWKLINNYAGHGSRRVYNSLTQRLITLT

SEQ ID NO: 11902 - protein, 203 aa, Escherichia coli DEC4B; identical to SEQ ID NO: 6414

SEQ ID NO: 11903 - protein, 696 aa, Escherichia coli DEC4B
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLKAAVNNLLNKDYSDVSLYSAGKSTLYAGDYFQTGSSTTGYVIPERNYWMSLNYQF

SEQ ID NO: 11904 - protein, 209 aa, Escherichia coli DEC4B; identical to SEQ ID NO: 11379

SEQ ID NO: 11905 - protein, 840 aa, Escherichia coli DEC4B; identical to SEQ ID NO: 11380

SEQ ID NO: 11906 - protein, 233 aa, Escherichia coli DEC4B; identical to SEQ ID NO: 11381

SEQ ID NO: 11907 - protein, 191 aa, Escherichia coli DEC4B; identical to SEQ ID NO: 5748

SEQ ID NO: 11908 - protein, 232 aa, Escherichia coli DEC4B; identical to SEQ ID NO: 5747

SEQ ID NO: 11909 - protein, 729 aa, Escherichia coli DEC4B; identical to SEQ ID NO: 5745

SEQ ID NO: 11910 - protein, 213 aa, Escherichia coli DEC4B; identical to SEQ ID NO: 5744

SEQ ID NO: 11911 - protein, 203 aa, Escherichia coli DEC4B; identical to SEQ ID NO: 6347

SEQ ID NO: 11912 - protein, 207 aa, Escherichia coli DEC4B; identical to SEQ ID NO: 5743

SEQ ID NO: 11913 - protein, 113 aa, Escherichia coli DEC4B; identical to SEQ ID NO: 11551

SEQ ID NO: 11914 - protein, 871 aa, Escherichia coli DEC4B; identical to SEQ ID NO: 11363

SEQ ID NO: 11915 - protein, 366 aa, Escherichia coli DEC4B; identical to SEQ ID NO: 11362

SEQ ID NO: 11916 - protein, 700 aa, Escherichia coli DEC4B; identical to SEQ ID NO: 5740

SEQ ID NO: 11917 - protein, 539 aa, Escherichia coli DEC4B; identical to SEQ ID NO: 6525

SEQ ID NO: 11918 - protein, 245 aa, Escherichia coli DEC4B
MTERELSIIRALGEEFAMVLADLQRTFEEKIAAQAQTFEEKLASQSVVLQKCVTGDDVRPMLEQMVKEAVSHIPVPRDGRDYDPDVLQKAVNDAVSALPAPQDGRDATALEILPAIDDQKSFPRGSYATHQGGLWRAYEKTYGMRGWECLVDGVADIDVSMTGERSFSVVVRQSSGQRTEKTFSLPVMLYRGVFRIGETYHPGDTVTWGGSLWHCNSMTGDKPGEAHSSGWTLAAKRGRDAGGGK

SEQ ID NO: 11919 - protein, 191 aa, Escherichia coli DEC4B; identical to SEQ ID NO: 5701

SEQ ID NO: 11920 - protein, 111 aa, Escherichia coli DEC4B; identical to SEQ ID NO: 5738

SEQ ID NO: 11921 - protein, 118 aa, Escherichia coli DEC4B [sequence omitted]

SEQ ID NO: 11922 - protein, 826 aa, Escherichia coli DEC4B; identical to SEQ ID NO: 11397

SEQ ID NO: 11923 - protein, 224 aa, Escherichia coli DEC4B; identical to SEQ ID NO: 11398

SEQ ID NO: 11924 - protein, 627 aa, Escherichia coli DEC4B; identical to SEQ ID NO: 11401

SEQ ID NO: 11925 - protein, 274 aa, Escherichia coli DEC4B; identical to SEQ ID NO: 5731

SEQ ID NO: 11926 - protein, 252 aa, Escherichia coli DEC4B; identical to SEQ ID NO: 11406

SEQ ID NO: 11927 - protein, 860 aa, Escherichia coli DEC4B; identical to SEQ ID NO: 11720

SEQ ID NO: 11928 - protein, 89 aa, Escherichia coli DEC4B; identical to SEQ ID NO: 6233

SEQ ID NO: 11929 - protein, 162 aa, Escherichia coli DEC4B; identical to SEQ ID NO: 5734

SEQ ID NO: 11930 - protein, 367 aa, Escherichia coli DEC4B; identical to SEQ ID NO: 5700

SEQ ID NO: 11931 - protein, 518 aa, Escherichia coli DEC4B; identical to SEQ ID NO: 11400

SEQ ID NO: 11932 - protein, 359 aa, Escherichia coli DEC4B; identical to SEQ ID NO: 11410

SEQ ID NO: 11933 - protein, 432 aa, Escherichia coli DEC4B; identical to SEQ ID NO: 5727

SEQ ID NO: 11934 - protein, 567 aa, Escherichia coli DEC4B; identical to SEQ ID NO: 11409

SEQ ID NO: 11935 - protein, 713 aa, Escherichia coli DEC4B; identical to SEQ ID NO: 11726

SEQ ID NO: 11936 - protein, 231 aa, Escherichia coli DEC4B; identical to SEQ ID NO: 5724

SEQ ID NO: 11937 - protein, 838 aa, Escherichia coli DEC4B; identical to SEQ ID NO: 5723

SEQ ID NO: 11938 - protein, 678 aa, Escherichia coli DEC4B; identical to SEQ ID NO: 5722

SEQ ID NO: 11939 - protein, 386 aa, Escherichia coli DEC4B; identical to SEQ ID NO: 11415

SEQ ID NO: 11940 - protein, 108 aa, Escherichia coli DEC4B; identical to SEQ ID NO: 11583

SEQ ID NO: 11941 - protein, 629 aa, Escherichia coli DEC4B
MTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 11942 - protein, 324 aa, Escherichia coli DEC4B; identical to SEQ ID NO: 11498

SEQ ID NO: 11943 - protein, 229 aa, Escherichia coli DEC4B; identical to SEQ ID NO: 11418

SEQ ID NO: 11944 - protein, 514 aa, Escherichia coli DEC4B; identical to SEQ ID NO: 11496

SEQ ID NO: 11945 - protein, 975 aa, Escherichia coli DEC4B
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGGTAENVGNNLGKAGTVLSALQNFTGIALSGMALDELLRKQRAGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARIISELGDKDDVVYSGAGSSEVFAGEGYDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYGQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKTWLISPVLPMILIRLFLQFQGSIQVMND

SEQ ID NO: 11946 - protein, 650 aa, Escherichia coli DEC4B; identical to SEQ ID NO: 11539

SEQ ID NO: 11947 - protein, 614 aa, Escherichia coli DEC4B; identical to SEQ ID NO: 5715

SEQ ID NO: 11948 - protein, 208 aa, Escherichia coli DEC4B; identical to SEQ ID NO: 5717

SEQ ID NO: 11949 - protein, 237 aa, Escherichia coli DEC4B; identical to SEQ ID NO: 5713

SEQ ID NO: 11950 - protein, 478 aa, Escherichia coli DEC4B; identical to SEQ ID NO: 5711

SEQ ID NO: 11951 - protein, 633 aa, Escherichia coli DEC4B
MLRTTRWVAAIIFLYSFPGYAEETFDTHFMIGGMKGEKVSEYHFDNKQPLPGNYELDFYVNNQWRGKQDITIPESPVKPCLPKVLLTKLGVKTGNLNTEDNCILLDKAVHGGQYQWDISEHRLNLTVPQAYINELERGYVPPESWDRGIDAFYTSYNLSQYRSYDSNNNSNTASYGRFNSGLNLFSWQLHSDASYSKPDDMKGTWQSNTLYLEHGWSQILSTVQIGENYTSSLIFDSLRFSGIRLFRDMQMLPDSMQSFTPLVQGVAQSNALITVSQNGYIIYQKEVPPGPFTIADLQLSGSGSDLDVSIKEADGSVRSFLVPYSSVPNMLQPGISNFDFIAGRSKIYGVKNQEDFLEANYIYGLNNLLTLYGGTILSDNYNAITLGNGWNTPLGAISFDATRSSSKLNNDITHEGTSYQVAYNKYLVQTATRFSVAAWRYASQDYRTFSDHLYENDKINHQSDYDDFYDIGRKNSLSANIMQPLSNNLGNVSLSALWRNYWGRSGNAKDYQFSYSNSWQRISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPIATIDGSYSHSKNA

SEQ ID NO: 11952 - protein, 227 aa, Escherichia coli DEC4B; identical to SEQ ID NO: 11429

SEQ ID NO: 11953 - protein, 241 aa, Escherichia coli DEC4B; identical to SEQ ID NO: 11431

SEQ ID NO: 11954 - protein, 446 aa, Escherichia coli DEC4B; identical to SEQ ID NO: 5714

SEQ ID NO: 11955 - protein, 368 aa, Escherichia coli DEC4B; identical to SEQ ID NO: 11425

SEQ ID NO: 11956 - protein, 241 aa, Escherichia coli DEC4B; identical to SEQ ID NO: 5709

SEQ ID NO: 11957 - protein, 856 aa, Escherichia coli DEC4B; identical to SEQ ID NO: 11664

SEQ ID NO: 11958 - protein, 784 aa, Escherichia coli DEC4B; identical to SEQ ID NO: 5705

SEQ ID NO: 11959 - protein, 170 aa, Escherichia coli DEC4B; identical to SEQ ID NO: 5855

SEQ ID NO: 11960 - protein, 89 aa, Escherichia coli DEC4B; identical to SEQ ID NO: 6053

SEQ ID NO: 11961 - protein, 747 aa, Escherichia coli DEC4C; identical to SEQ ID NO: 5775

SEQ ID NO: 11962 - protein, 266 aa, Escherichia coli DEC4C; identical to SEQ ID NO: 5771

SEQ ID NO: 11963 - protein, 161 aa, Escherichia coli DEC4C; identical to SEQ ID NO: 5769

SEQ ID NO: 11964 - protein, 351 aa, Escherichia coli DEC4C; identical to SEQ ID NO: 5767

SEQ ID NO: 11965 - protein, 230 aa, Escherichia coli DEC4C; identical to SEQ ID NO: 5765

SEQ ID NO: 11966 - protein, 869 aa, Escherichia coli DEC4C; identical to SEQ ID NO: 5763

SEQ ID NO: 11967 - protein, 746 aa, Escherichia coli DEC4C; identical to SEQ ID NO: 5761

SEQ ID NO: 11968 - protein, 193 aa, Escherichia coli DEC4C; identical to SEQ ID NO: 5760

SEQ ID NO: 11969 - protein, 243 aa, Escherichia coli DEC4C; identical to SEQ ID NO: 11367

SEQ ID NO: 11970 - protein, 816 aa, Escherichia coli DEC4C; identical to SEQ ID NO: 11682

SEQ ID NO: 11971 - protein, 430 aa, Escherichia coli DEC4C; identical to SEQ ID NO: 5758

SEQ ID NO: 11972 - protein, 331 aa, Escherichia coli DEC4C; identical to SEQ ID NO: 6551

SEQ ID NO: 11973 - protein, 760 aa, Escherichia coli DEC4C; identical to SEQ ID NO: 5756

SEQ ID NO: 11974 - protein, 203 aa, Escherichia coli DEC4C; identical to SEQ ID NO: 6414

SEQ ID NO: 11975 - protein, 361 aa, Escherichia coli DEC4C; identical to SEQ ID NO: 11373

SEQ ID NO: 11976 - protein, 233 aa, Escherichia coli DEC4C; identical to SEQ ID NO: 5752

SEQ ID NO: 11977 - protein, 370 aa, Escherichia coli DEC4C; identical to SEQ ID NO: 11375

SEQ ID NO: 11978 - protein, 170 aa, Escherichia coli DEC4C; identical to SEQ ID NO: 11901

SEQ ID NO: 11979 - protein, 405 aa, Escherichia coli DEC4C
MTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 11980 - protein, 729 aa, Escherichia coli DEC4C; identical to SEQ ID NO: 5745

SEQ ID NO: 11981 - protein, 213 aa, Escherichia coli DEC4C; identical to SEQ ID NO: 5744

SEQ ID NO: 11982 - protein, 209 aa, Escherichia coli DEC4C; identical to SEQ ID NO: 11379

SEQ ID NO: 11983 - protein, 840 aa, Escherichia coli DEC4C; identical to SEQ ID NO: 11380

SEQ ID NO: 11984 - protein, 163 aa, Escherichia coli DEC4C
MPTPQTFRMEAAAGQALRLLYTGNNLPQDRESVFWFSFSQLPYLNKNDKSQNQLILALTNRVKIFYRPSSIVGKSSDAPKNLTYQVKQNRIEVTNPTGYYVTIRAAELLNNGKKVPLANSVMIAPQSTTEWTLPSGISVAPGAQIHLVTVNDYGVNVTSEHAL

SEQ ID NO: 11985 - protein, 670 aa, Escherichia coli DEC4C
MMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 11986 - protein, 517 aa, Escherichia coli DEC4C; identical to SEQ ID NO: 6817

SEQ ID NO: 11987 - protein, 191 aa, Escherichia coli DEC4C; identical to SEQ ID NO: 5748

SEQ ID NO: 11988 - protein, 232 aa, Escherichia coli DEC4C; identical to SEQ ID NO: 5747

SEQ ID NO: 11989 - protein, 203 aa, Escherichia coli DEC4C; identical to SEQ ID NO: 6347

SEQ ID NO: 11990 - protein, 207 aa, Escherichia coli DEC4C; identical to SEQ ID NO: 5743

SEQ ID NO: 11991 - protein, 236 aa, Escherichia coli DEC4C; identical to SEQ ID NO: 11364

SEQ ID NO: 11992 - protein, 871 aa, Escherichia coli DEC4C; identical to SEQ ID NO: 11363

SEQ ID NO: 11993 - protein, 366 aa, Escherichia coli DEC4C; identical to SEQ ID NO: 11362

SEQ ID NO: 11994 - protein, 650 aa, Escherichia coli DEC4C; identical to SEQ ID NO: 11539

SEQ ID NO: 11995 - protein, 616 aa, Escherichia coli DEC4C
MLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARIISELGDKDDVVYSGAGSSEVFAGEGYDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYGQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKNMVNITSVANDINKIISSVSGFDSGDERLASLYNLSLHQNNTHSTTLTTTV

SEQ ID NO: 11996 - protein, 273 aa, Escherichia coli DEC4C
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAV

SEQ ID NO: 11997 - protein, 700 aa, Escherichia coli DEC4C; identical to SEQ ID NO: 5740

SEQ ID NO: 11998 - protein, 539 aa, Escherichia coli DEC4C; identical to SEQ ID NO: 6525

SEQ ID NO: 11999 - protein, 130 aa, Escherichia coli DEC4C; identical to SEQ ID NO: 7726

SEQ ID NO: 12000 - protein, 191 aa, Escherichia coli DEC4C; identical to SEQ ID NO: 5701

SEQ ID NO: 12001 - protein, 102 aa, Escherichia coli DEC4C; identical to SEQ ID NO: 11707

SEQ ID NO: 12002 - protein, 715 aa, Escherichia coli DEC4C
MLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDDDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 12003 - protein, 826 aa, Escherichia coli DEC4C; identical to SEQ ID NO: 11397

SEQ ID NO: 12004 - protein, 224 aa, Escherichia coli DEC4C
MKGLLSLLISSMIFPVHAGMVIFGTRIIYPAEQKEVMVQLMNQGNRSSLMQAWIDDGDTSLPPEKIQVPFMLTPPVVKVAANSGQQIKIKIMPNKLPSNKESIFYLNVLDIPPNSPEDEGKNALKFAMQNRIKLFYRPAGIAPVNKTTFKKLRVSRSGNNVVIKNDSPNWVTISDVKANNVKVNYETIMIAPQESQNVSVKNNNANGWQLTIIDDHGNYISDKI

SEQ ID NO: 12005 - protein, 291 aa, Escherichia coli DEC4C
MLEQMVKEAVSHIPVPRDGRDYDPEVLQKAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 12006 - protein, 637 aa, Escherichia coli DEC4C; identical to SEQ ID NO: 11485

SEQ ID NO: 12007 - protein, 162 aa, Escherichia coli DEC4C; identical to SEQ ID NO: 5734

SEQ ID NO: 12008 - protein, 367 aa, Escherichia coli DEC4C; identical to SEQ ID NO: 5700

SEQ ID NO: 12009 - protein, 200 aa, Escherichia coli DEC4C; identical to SEQ ID NO: 5732

SEQ ID NO: 12010 - protein, 274 aa, Escherichia coli DEC4C; identical to SEQ ID NO: 5731

SEQ ID NO: 12011 - protein, 252 aa, Escherichia coli DEC4C; identical to SEQ ID NO: 11406

SEQ ID NO: 12012 - protein, 860 aa, Escherichia coli DEC4C
MSGSYVNAWAENEIQFDSRFLELKGDTKIDLKRFSSQGYVEPGKYNLQVQLNKQPLTEEYDIYWYASENDASKTYACLTPELVAQFGLKEDVAKKLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDITHSHTRLDKETAYGKGSLDGNSFRLSYSKDFDELNSRVTFAGYRFSEENFMTMSEYLDASDSEMVRTGNDKEMYTATYNQNFRDAGVSVYLNYTRHTYWDRDEQTNYNVMLSHYFNLGSIRNMSISMTGYRYEYDNQADKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQATLTEGAIGYRKFSVISGQKAMAVLRLQDGSYPPFGAEVKNDSAQNVGLVDDDGNVYLAGVKPGEHMIVSWGGVAHCDIHLPDPLPADLFNGLLLPCQQTGAISPSMPHEIKPVIQEQTQQVMPTEAPVSVSAN

SEQ ID NO: 12013 - protein, 518 aa, Escherichia coli DEC4C; identical to SEQ ID NO: 11400

SEQ ID NO: 12014 - protein, 432 aa, Escherichia coli DEC4C; identical to SEQ ID NO: 5727

SEQ ID NO: 12015 - protein, 567 aa, Escherichia coli DEC4C; identical to SEQ ID NO: 11409

SEQ ID NO: 12016 - protein, 359 aa, Escherichia coli DEC4C; identical to SEQ ID NO: 11410

SEQ ID NO: 12017 - protein, 689 aa, Escherichia coli DEC4C
MIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPHHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 12018 - protein, 231 aa, Escherichia coli DEC4C; identical to SEQ ID NO: 5724

SEQ ID NO: 12019 - protein, 721 aa, Escherichia coli DEC4C; identical to SEQ ID NO: 11576

SEQ ID NO: 12020 - protein, 678 aa, Escherichia coli DEC4C; identical to SEQ ID NO: 5722

SEQ ID NO: 12021 - protein, 386 aa, Escherichia coli DEC4C; identical to SEQ ID NO: 11415

SEQ ID NO: 12022 - protein, 612 aa, Escherichia coli DEC4C
MVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 12023 - protein, 324 aa, Escherichia coli DEC4C; identical to SEQ ID NO: 11498

SEQ ID NO: 12024 - protein, 229 aa, Escherichia coli DEC4C; identical to SEQ ID NO: 11418

SEQ ID NO: 12025 - protein, 110 aa, Escherichia coli DEC4C; identical to SEQ ID NO: 11497

SEQ ID NO: 12026 - protein, 514 aa, Escherichia coli DEC4C; identical to SEQ ID NO: 11496

SEQ ID NO: 12027 - protein, 208 aa, Escherichia coli DEC4C
MKKIWLALAGLVLAFSASAAQYEDGKQYTTLEKPVAGAPQVLEFFSFFCPHCYQFEEVLHISDNVKKKLPEGVKMTKYHVNFMGGDLGKDLTQAWAVAMALGVEDKVTVPLFEGVQKTQTIRSASDIRDVFINTGIKGEEYDAAWNSFVVKSLVAQQEKAAADVQLRGVPAMFVNGKYQLNPQGMDTSNMDVFVQQYADTVKYLSEKK

SEQ ID NO: 12028 - protein, 468 aa, Escherichia coli DEC4C; identical to SEQ ID NO: 11875

SEQ ID NO: 12029 - protein, 446 aa, Escherichia coli DEC4C; identical to SEQ ID NO: 5714

SEQ ID NO: 12030 - protein, 227 aa, Escherichia coli DEC4C; identical to SEQ ID NO: 11429

SEQ ID NO: 12031 - protein, 784 aa, Escherichia coli DEC4C; identical to SEQ ID NO: 5705

SEQ ID NO: 12032 - protein, 237 aa, Escherichia coli DEC4C; identical to SEQ ID NO: 5713

SEQ ID NO: 12033 - protein, 478 aa, Escherichia coli DEC4C; identical to SEQ ID NO: 5711

SEQ ID NO: 12034 - protein, 241 aa, Escherichia coli DEC4C; identical to SEQ ID NO: 5709

SEQ ID NO: 12035 - protein, 856 aa, Escherichia coli DEC4C
MAGFFVRLFVACAFAVQAPLSSAELYFNPRFLADDPQAVADLSRFENGQELPPGTYRVDIYLNNGYMATRDVTFNTGDSEQGVVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLARNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLNNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 12036 - protein, 170 aa, Escherichia coli DEC4C; identical to SEQ ID NO: 5855

SEQ ID NO: 12037 - protein, 241 aa, Escherichia coli DEC4C; identical to SEQ ID NO: 11431

SEQ ID NO: 12038 - protein, 351 aa, Escherichia coli DEC4D; identical to SEQ ID NO: 5767

SEQ ID NO: 12039 - protein, 230 aa, Escherichia coli DEC4D; identical to SEQ ID NO: 5765

SEQ ID NO: 12040 - protein, 869 aa, Escherichia coli DEC4D
MKIPTTTDIPQRYTWCLAGICYSSLAILPSFLSYAESYFNPAFLLENGTFVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYDTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 12041 - protein, 746 aa, Escherichia coli DEC4D; identical to SEQ ID NO: 5761

SEQ ID NO: 12042 - protein, 193 aa, Escherichia coli DEC4D; identical to SEQ ID NO: 5760

SEQ ID NO: 12043 - protein, 243 aa, Escherichia coli DEC4D; identical to SEQ ID NO: 11367

SEQ ID NO: 12044 - protein, 816 aa, Escherichia coli DEC4D; identical to SEQ ID NO: 11682

SEQ ID NO: 12045 - protein, 430 aa, Escherichia coli DEC4D; identical to SEQ ID NO: 5758

SEQ ID NO: 12046 - protein, 331 aa, Escherichia coli DEC4D; identical to SEQ ID NO: 6551

SEQ ID NO: 12047 - protein, 760 aa, Escherichia coli DEC4D; identical to SEQ ID NO: 5756

SEQ ID NO: 12048 - protein, 203 aa, Escherichia coli DEC4D; identical to SEQ ID NO: 6414

SEQ ID NO: 12049 - protein, 361 aa, Escherichia coli DEC4D; identical to SEQ ID NO: 11373

SEQ ID NO: 12050 - protein, 224 aa, Escherichia coli DEC4D; identical to SEQ ID NO: 11374

SEQ ID NO: 12051 - protein, 630 aa, Escherichia coli DEC4D; identical to SEQ ID NO: 11690

SEQ ID NO: 12052 - protein, 173 aa, Escherichia coli DEC4D
MALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGCRATRWKLINNYAGHGSRRVYNSLTQRLITLT

SEQ ID NO: 12053 - protein, 735 aa, Escherichia coli DEC4D
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGGTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARIISELGDKDDVVYSGAGSSEVFAGEGYDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEG

SEQ ID NO: 12054 - protein, 650 aa, Escherichia coli DEC4D; identical to SEQ ID NO: 11539

SEQ ID NO: 12055 - protein, 89 aa, Escherichia coli DEC4D; identical to SEQ ID NO: 6053

SEQ ID NO: 12056 - protein, 409 aa, Escherichia coli DEC4D
MVVNTVASENPDEAGRYSMDVEYGQYSVILLVEGFPPSHAGTITVYEDSQPGTLNDFLGAMSEDDVRPEALRRFELMVEEAARHAEEAKKNAGEAETSARNAGISASQAEESAANADTSAGDASESARQAAESAAAAKQSEEASSSSASAAAQKASESLQSATDAELSKKTAESAAGNAARDATTAAEKARESAESAQSAEQSRIAAEEAVNRIPTVVGPPGPKGEQGPAGPQGPKGDKGERGDTGPVGATGERGPAGDAGPAGPQGPKGDRGERGETGLTGNAGPQGPKGDTGAAGPAGPQGPKGETGAAGPVGATGPQGPKGDPGETQIRFRLGPASIIETNSHGWFPGTDGALITGLTFLAPKDTTRVQGFFSICRSGLVTGRGRMLRGWMKWAVIQAEQENDMNI

SEQ ID NO: 12057 - protein, 209 aa, Escherichia coli DEC4D; identical to SEQ ID NO: 11379

SEQ ID NO: 12058 - protein, 840 aa, Escherichia coli DEC4D; identical to SEQ ID NO: 11380

SEQ ID NO: 12059 - protein, 233 aa, Escherichia coli DEC4D; identical to SEQ ID NO: 11381

SEQ ID NO: 12060 - protein, 669 aa, Escherichia coli DEC4D; identical to SEQ ID NO: 8890

SEQ ID NO: 12061 - protein, 191 aa, Escherichia coli DEC4D; identical to SEQ ID NO: 5748

SEQ ID NO: 12062 - protein, 232 aa, Escherichia coli DEC4D; identical to SEQ ID NO: 5747

SEQ ID NO: 12063 - protein, 729 aa, Escherichia coli DEC4D; identical to SEQ ID NO: 5745

SEQ ID NO: 12064 - protein, 213 aa, Escherichia coli DEC4D; identical to SEQ ID NO: 5744

SEQ ID NO: 12065 - protein, 407 aa, Escherichia coli DEC4D
MTERELSIIRALGEEFAMVLADLQRTFEEKIAAQAQTFEEKLASQSVVLQKCVTGDDVRPMLEQMVKEAVSHIPVPRDGRDYDPDVLQKAVNDAVANIPVPADGKSITPDDVRPMLEQMVKEAVSHIPVPRDGRDYDPDVLQKAVNDAVAKIPVPADGKSITPDDVHPMLEQMVKEAVSHIPVPRDGRDYDPDVLQKAVNDAVAKIPVPADGKSITPDDVHPMLEQMVKEAVSHIPVPRDGRDYDPDVLQKAVLEAVSALPAPQDGRDATALEILPAIDDQKSFPRGSYATHQGGLWRAYEKTYGMRGWECLVDGVADIDVSMTGERSFSVVVRQSSGQRTEKTFSLPVMLYRGVFRIGETYHPGDTVTWGGSLWHCNSMTADKPGDAHASGWTLAAKRGRDAGGGK

SEQ ID NO: 12066 - protein, 203 aa, Escherichia coli DEC4D; identical to SEQ ID NO: 6347

SEQ ID NO: 12067 - protein, 207 aa, Escherichia coli DEC4D; identical to SEQ ID NO: 5743

SEQ ID NO: 12068 - protein, 236 aa, Escherichia coli DEC4D; identical to SEQ ID NO: 11364

SEQ ID NO: 12069 - protein, 366 aa, Escherichia coli DEC4D; identical to SEQ ID NO: 11362

SEQ ID NO: 12070 - protein, 446 aa, Escherichia coli DEC4D; identical to SEQ ID NO: 5714

SEQ ID NO: 12071 - protein, 700 aa, Escherichia coli DEC4D; identical to SEQ ID NO: 5740

SEQ ID NO: 12072 - protein, 539 aa, Escherichia coli DEC4D
MAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLARDIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 12073 - protein, 118 aa, Escherichia coli DEC4D [sequence omitted]

SEQ ID NO: 12074 - protein, 191 aa, Escherichia coli DEC4D; identical to SEQ ID NO: 5701

SEQ ID NO: 12075 - protein, 111 aa, Escherichia coli DEC4D; identical to SEQ ID NO: 5738

SEQ ID NO: 12076 - protein, 715 aa, Escherichia coli DEC4D; identical to SEQ ID NO: 11710

SEQ ID NO: 12077 - protein, 826 aa, Escherichia coli DEC4D; identical to SEQ ID NO: 11397

SEQ ID NO: 12078 - protein, 224 aa, Escherichia coli DEC4D; identical to SEQ ID NO: 12004

SEQ ID NO: 12079 - protein, 637 aa, Escherichia coli DEC4D; identical to SEQ ID NO: 11485

SEQ ID NO: 12080 - protein, 162 aa, Escherichia coli DEC4D; identical to SEQ ID NO: 5734

SEQ ID NO: 12081 - protein, 367 aa, Escherichia coli DEC4D; identical to SEQ ID NO: 5700

SEQ ID NO: 12082 - protein, 200 aa, Escherichia coli DEC4D; identical to SEQ ID NO: 5732

SEQ ID NO: 12083 - protein, 274 aa, Escherichia coli DEC4D; identical to SEQ ID NO: 5731

SEQ ID NO: 12084 - protein, 252 aa, Escherichia coli DEC4D; identical to SEQ ID NO: 11406

SEQ ID NO: 12085 - protein, 860 aa, Escherichia coli DEC4D; identical to SEQ ID NO: 12012

SEQ ID NO: 12086 - protein, 518 aa, Escherichia coli DEC4D; identical to SEQ ID NO: 11400

SEQ ID NO: 12087 - protein, 432 aa, Escherichia coli DEC4D; identical to SEQ ID NO: 5727

SEQ ID NO: 12088 - protein, 567 aa, Escherichia coli DEC4D; identical to SEQ ID NO: 11409

SEQ ID NO: 12089 - protein, 359 aa, Escherichia coli DEC4D; identical to SEQ ID NO: 11410

SEQ ID NO: 12090 - protein, 689 aa, Escherichia coli DEC4D; identical to SEQ ID NO: 12017

SEQ ID NO: 12091 - protein, 231 aa, Escherichia coli DEC4D; identical to SEQ ID NO: 5724

SEQ ID NO: 12092 - protein, 838 aa, Escherichia coli DEC4D; identical to SEQ ID NO: 5723

SEQ ID NO: 12093 - protein, 678 aa, Escherichia coli DEC4D; identical to SEQ ID NO: 5722

SEQ ID NO: 12094 - protein, 660 aa, Escherichia coli DEC4D; identical to SEQ ID NO: 11731

SEQ ID NO: 12095 - protein, 324 aa, Escherichia coli DEC4D; identical to SEQ ID NO: 11498

SEQ ID NO: 12096 - protein, 229 aa, Escherichia coli DEC4D; identical to SEQ ID NO: 11418

SEQ ID NO: 12097 - protein, 386 aa, Escherichia coli DEC4D; identical to SEQ ID NO: 11415

SEQ ID NO: 12098 - protein, 514 aa, Escherichia coli DEC4D; identical to SEQ ID NO: 11496

SEQ ID NO: 12099 - protein, 108 aa, Escherichia coli DEC4D; identical to SEQ ID NO: 11583

SEQ ID NO: 12100 - protein, 208 aa, Escherichia coli DEC4D; identical to SEQ ID NO: 12027

SEQ ID NO: 12101 - protein, 614 aa, Escherichia coli DEC4D; identical to SEQ ID NO: 5715

SEQ ID NO: 12102 - protein, 816 aa, Escherichia coli DEC4D; identical to SEQ ID NO: 11428

SEQ ID NO: 12103 - protein, 227 aa, Escherichia coli DEC4D; identical to SEQ ID NO: 11429

SEQ ID NO: 12104 - protein, 784 aa, Escherichia coli DEC4D; identical to SEQ ID NO: 5705

SEQ ID NO: 12105 - protein, 170 aa, Escherichia coli DEC4D; identical to SEQ ID NO: 5855

SEQ ID NO: 12106 - protein, 228 aa, Escherichia coli DEC4D; identical to SEQ ID NO: 11502

SEQ ID NO: 12107 - protein, 747 aa, Escherichia coli DEC4D; identical to SEQ ID NO: 5775

SEQ ID NO: 12108 - protein, 266 aa, Escherichia coli DEC4D; identical to SEQ ID NO: 5771

SEQ ID NO: 12109 - protein, 161 aa, Escherichia coli DEC4D; identical to SEQ ID NO: 5769

SEQ ID NO: 12110 - protein, 237 aa, Escherichia coli DEC4D; identical to SEQ ID NO: 5713

SEQ ID NO: 12111 - protein, 368 aa, Escherichia coli DEC4D; identical to SEQ ID NO: 11425

SEQ ID NO: 12112 - protein, 241 aa, Escherichia coli DEC4D; identical to SEQ ID NO: 5709

SEQ ID NO: 12113 - protein, 863 aa, Escherichia coli DEC4D
MHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLARNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLNNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 12114 - protein, 747 aa, Escherichia coli DEC4E; identical to SEQ ID NO: 5775

SEQ ID NO: 12115 - protein, 266 aa, Escherichia coli DEC4E; identical to SEQ ID NO: 5771

SEQ ID NO: 12116 - protein, 161 aa, Escherichia coli DEC4E; identical to SEQ ID NO: 5769

SEQ ID NO: 12117 - protein, 98 aa, Escherichia coli DEC4E
MTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 12118 - protein, 366 aa, Escherichia coli DEC4E; identical to SEQ ID NO: 11362

SEQ ID NO: 12119 - protein, 871 aa, Escherichia coli DEC4E; identical to SEQ ID NO: 11363

SEQ ID NO: 12120 - protein, 236 aa, Escherichia coli DEC4E; identical to SEQ ID NO: 11364

SEQ ID NO: 12121 - protein, 430 aa, Escherichia coli DEC4E; identical to SEQ ID NO: 5758

SEQ ID NO: 12122 - protein, 230 aa, Escherichia coli DEC4E; identical to SEQ ID NO: 5765

SEQ ID NO: 12123 - protein, 869 aa, Escherichia coli DEC4E
MKILTTTDIPQRYTWCLAGICYSSLAILPSFLSYAESYFNPAFLLENGTFVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 12124 - protein, 746 aa, Escherichia coli DEC4E; identical to SEQ ID NO: 5761

SEQ ID NO: 12125 - protein, 193 aa, Escherichia coli DEC4E; identical to SEQ ID NO: 5760

SEQ ID NO: 12126 - protein, 243 aa, Escherichia coli DEC4E; identical to SEQ ID NO: 11367

SEQ ID NO: 12127 - protein, 816 aa, Escherichia coli DEC4E; identical to SEQ ID NO: 11682

SEQ ID NO: 12128 - protein, 331 aa, Escherichia coli DEC4E; identical to SEQ ID NO: 6551

SEQ ID NO: 12129 - protein, 760 aa, Escherichia coli DEC4E; identical to SEQ ID NO: 5756

SEQ ID NO: 12130 - protein, 203 aa, Escherichia coli DEC4E; identical to SEQ ID NO: 6414

SEQ ID NO: 12131 - protein, 361 aa, Escherichia coli DEC4E; identical to SEQ ID NO: 11373

SEQ ID NO: 12132 - protein, 224 aa, Escherichia coli DEC4E; identical to SEQ ID NO: 11374

SEQ ID NO: 12133 - protein, 630 aa, Escherichia coli DEC4E
MQRAVIPLKGELTVGDDYTAGDFFDSVSFRGVQLASDDNMLPDSLKGVAPVVRGIAKSNAQITIKQNGYTIYQTYVSPGAFEISDIYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLSEYGSFYLSGSQQTYWHTDQQDRLLQFGYNTQIKDLSLGISWNYSKSRGQPDADQVFALNFSLPLNLLLSRSNDSYTSKKNYAWMTSNTSIDNEGHTTQNLGLTETLLDDGNLSYSVQQGYNSEGKTANGSASMDYKGVFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGISLRFGAIATLDGVQTNSGIIDDDGSLYMAGLPAKGTITVRWGEAPDQICHISYELTEQQINSAITRMDAICR

SEQ ID NO: 12134 - protein, 170 aa, Escherichia coli DEC4E; identical to SEQ ID NO: 11901

SEQ ID NO: 12135 - protein, 446 aa, Escherichia coli DEC4E; identical to SEQ ID NO: 5714

SEQ ID NO: 12136 - protein, 359 aa, Escherichia coli DEC4E
MVVNTVASENPDEAGRYSMDVEYGQYSVILLVEGFPPSHAGTITVYEDSQPGTLNDFLGAMSEDDVRPEALRRFELMVEEAARHAEEAKKNAGEAETSARNAGISASQAEESAANADTSAGDASESARQAAESAAAAKQSEEASSSSASAAAQKASESSQSAAEAELSRKTAESAAGNAARDATTATEKARESAESAQSAEQSRIAAEEAVNRIPTVVGPPGPKGEQGPAGPQGPKGDKGERGDTGPAGATGERGPAGDAGPAGPQGPKGDRGERGETGLTGNAGPQGPKGDTGAAGPAGPQGPKGETGAAGPVGATGPQGPKGDPGETQIRFRWGRRALLRQTAMAGSRVQMVRSSPD

SEQ ID NO: 12137 - protein, 209 aa, Escherichia coli DEC4E; identical to SEQ ID NO: 11379

SEQ ID NO: 12138 - protein, 669 aa, Escherichia coli DEC4E
MNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTTVGLNASKGQDYWQASGNVQGAMAVHGGGITFGPYLGETFALVEAKGAEGAKVYNSSQLEINDSGYALVPAVTPYRYNRISLDPQGMDGDAELVDSERQVAPVAGAAVKVIFRTRPGKALLIKSRMADGSELPMGADVLDENNTVVGIAGQGGQIYLRTEQTKGHLSVRWGEGANDSCQLPFDISGKDSNSPIIRLNETCQS

SEQ ID NO: 12139 - protein, 155 aa, Escherichia coli DEC4E
MEAAAGQALRLLYTGNNLPQDRESVFWFSFSQLPYLNKNDKSQNQLILALTNRVKIFYRPSSIVGKSSDAPKNLTYQVKQNRIEVTNPTGYYVTIRAAELLNNGKKVPLANSVMIAPQSTTEWTLPSGISVAPGAQIHLVTVNDYGVNVTSEHAL

SEQ ID NO: 12140 - protein, 650 aa, Escherichia coli DEC4E; identical to SEQ ID NO: 11539

SEQ ID NO: 12141 - protein, 998 aa, Escherichia coli DEC4E; identical to SEQ ID NO: 6058

SEQ ID NO: 12142 - protein, 669 aa, Escherichia coli DEC4E; identical to SEQ ID NO: 8890

SEQ ID NO: 12143 - protein, 191 aa, Escherichia coli DEC4E; identical to SEQ ID NO: 5748

SEQ ID NO: 12144 - protein, 232 aa, Escherichia coli DEC4E; identical to SEQ ID NO: 5747

SEQ ID NO: 12145 - protein, 729 aa, Escherichia coli DEC4E; identical to SEQ ID NO: 5745

SEQ ID NO: 12146 - protein, 213 aa, Escherichia coli DEC4E; identical to SEQ ID NO: 5744

SEQ ID NO: 12147 - protein, 203 aa, Escherichia coli DEC4E; identical to SEQ ID NO: 6347

SEQ ID NO: 12148 - protein, 656 aa, Escherichia coli DEC4E; identical to SEQ ID NO: 11390

SEQ ID NO: 12149 - protein, 207 aa, Escherichia coli DEC4E; identical to SEQ ID NO: 5743

SEQ ID NO: 12150 - protein, 700 aa, Escherichia coli DEC4E; identical to SEQ ID NO: 5740

SEQ ID NO: 12151 - protein, 539 aa, Escherichia coli DEC4E; identical to SEQ ID NO: 6525

SEQ ID NO: 12152 - protein, 111 aa, Escherichia coli DEC4E; identical to SEQ ID NO: 5738

SEQ ID NO: 12153 - protein, 118 aa, Escherichia coli DEC4E [sequence omitted]

SEQ ID NO: 12154 - protein, 191 aa, Escherichia coli DEC4E
MSTSYDFDFGLSLGAAYSNSDRTDNQVHKGTHNTRYGDRFDATAGGETAVAWTVGAKYDANNVYLAAMYAEPRNMTGYGDADAIANKTQNFEVVAQYQFDFGLRPSIAYLQSKGKDLGGVNSDNFDSQGNHHYTNKDLVKYVDIGMTYYFNKNMSTYVDYKINLLDNDDDFYKENGIATDDIVAVGLVYQF

SEQ ID NO: 12155 - protein, 715 aa, Escherichia coli DEC4E
MLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSENHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 12156 - protein, 826 aa, Escherichia coli DEC4E
MLRMTPLASAIVALLLGIEAHAAEETFDTHFMMGGMKGEQVTNLRLDDNQPLPGQYDIDIYVNKQWRGKYEIIVKDNPHETCLTREIVKRLGINSDNFARENQCLTFEQLVQGGSYSWDIGIFRLDLAVPQAWVEELENGYVPPENWERGINAFYTSYYVSQYYSDYKASGNSKSTYVRFNSGLNLLGWQLHSDASFSKTDNNPGEWKSNALYLEHGFSQILGTLRIGDMYTSADIFDSVRFTGVRLFRDMQMLPNSKQNFTPRVQGIAQSNALVTIEQNGFVVYQKEVPPGPFSISDLQLAGGGADLDVSVKEADGSVTTYLVPYAAVPNMLQPGVSKYDFAAGRSHIEGASKQSDFVQAGYQYGFNNLLTLYGGTMVANNYYAFTLGTGWNTRIGAISVDATKSHSKQDNGDVFDGQSYQIAYNKFLSQTSTRFGLAAWRYSSRDYRTFNDYVWANNKDNYRRDKNDVYDIADYYQNDFGRKNSFSANMSQSLPEGWGSVSLSTLWRDYWGRSGSSKDYQLSYSNNWRRISYTLAASQAYDENHAEEKRFNIFISIPFDWGDDVTTPRRQIYMSNSTTFDDQGFASNNTGLSGTVGNRDQFNYGINLSHQHQGNETTAGANLTWTAPAATVNGSYSQSSTYRQVGASVSGGLVAWSGGVNLANRLSETFAVMHAPGIKDAYVNGQKYRTTNCNGVVVYDGLTPYRENHLMMDVSQSDSETELRGNRKMTAPYRGAVVLVDFDTDQRKPWFIKALRSDGQPLTFGYEVNDMHGHNIGVVGQGSQIFIRTNEIPPAVNVAIDKQQGLSCTITFGKEIDESKNYICR

SEQ ID NO: 12157 - protein, 224 aa, Escherichia coli DEC4E; identical to SEQ ID NO: 12004

SEQ ID NO: 12158 - protein, 162 aa, Escherichia coli DEC4E; identical to SEQ ID NO: 5734

SEQ ID NO: 12159 - protein, 367 aa, Escherichia coli DEC4E; identical to SEQ ID NO: 5700

SEQ ID NO: 12160 - protein, 200 aa, Escherichia coli DEC4E; identical to SEQ ID NO: 5732

SEQ ID NO: 12161 - protein, 274 aa, Escherichia coli DEC4E; identical to SEQ ID NO: 5731

SEQ ID NO: 12162 - protein, 252 aa, Escherichia coli DEC4E; identical to SEQ ID NO: 11406

SEQ ID NO: 12163 - protein, 860 aa, Escherichia coli DEC4E; identical to SEQ ID NO: 11720

SEQ ID NO: 12164 - protein, 89 aa, Escherichia coli DEC4E; identical to SEQ ID NO: 6232

SEQ ID NO: 12165 - protein, 627 aa, Escherichia coli DEC4E
MVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRNGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 12166 - protein, 518 aa, Escherichia coli DEC4E; identical to SEQ ID NO: 11400

SEQ ID NO: 12167 - protein, 432 aa, Escherichia coli DEC4E; identical to SEQ ID NO: 5727

SEQ ID NO: 12168 - protein, 567 aa, Escherichia coli DEC4E; identical to SEQ ID NO: 11409

SEQ ID NO: 12169 - protein, 359 aa, Escherichia coli DEC4E; identical to SEQ ID NO: 11410

SEQ ID NO: 12170 - protein, 713 aa, Escherichia coli DEC4E; identical to SEQ ID NO: 11726

SEQ ID NO: 12171 - protein, 231 aa, Escherichia coli DEC4E; identical to SEQ ID NO: 5724

SEQ ID NO: 12172 - protein, 838 aa, Escherichia coli DEC4E; identical to SEQ ID NO: 5723

SEQ ID NO: 12173 - protein, 678 aa, Escherichia coli DEC4E; identical to SEQ ID NO: 5722

SEQ ID NO: 12174 - protein, 386 aa, Escherichia coli DEC4E; identical to SEQ ID NO: 11415

SEQ ID NO: 12175 - protein, 629 aa, Escherichia coli DEC4E; identical to SEQ ID NO: 11941

SEQ ID NO: 12176 - protein, 367 aa, Escherichia coli DEC4E; identical to SEQ ID NO: 11417

SEQ ID NO: 12177 - protein, 229 aa, Escherichia coli DEC4E; identical to SEQ ID NO: 11418

SEQ ID NO: 12178 - protein, 514 aa, Escherichia coli DEC4E; identical to SEQ ID NO: 11496

SEQ ID NO: 12179 - protein, 108 aa, Escherichia coli DEC4E; identical to SEQ ID NO: 11583

SEQ ID NO: 12180 - protein, 208 aa, Escherichia coli DEC4E; identical to SEQ ID NO: 5717

SEQ ID NO: 12181 - protein, 614 aa, Escherichia coli DEC4E; identical to SEQ ID NO: 5715

SEQ ID NO: 12182 - protein, 478 aa, Escherichia coli DEC4E; identical to SEQ ID NO: 5711

SEQ ID NO: 12183 - protein, 816 aa, Escherichia coli DEC4E; identical to SEQ ID NO: 11428

SEQ ID NO: 12184 - protein, 209 aa, Escherichia coli DEC4E
MRIITALLMSFFILPVHAGVVIYGTRIIYPEKNREVLVQLMNQSKNASLIQAWIDDGNTTIAPEKIQVTFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSHNDITLKITTHQNMN

SEQ ID NO: 12185 - protein, 170 aa, Escherichia coli DEC4E; identical to SEQ ID NO: 5855

SEQ ID NO: 12186 - protein, 241 aa, Escherichia coli DEC4E; identical to SEQ ID NO: 11431

SEQ ID NO: 12187 - protein, 368 aa, Escherichia coli DEC4E; identical to SEQ ID NO: 11425

SEQ ID NO: 12188 - protein, 241 aa, Escherichia coli DEC4E; identical to SEQ ID NO: 5709

SEQ ID NO: 12189 - protein, 863 aa, Escherichia coli DEC4E; identical to SEQ ID NO: 11427

SEQ ID NO: 12190 - protein, 351 aa, Escherichia coli DEC4F; identical to SEQ ID NO: 5767

SEQ ID NO: 12191 - protein, 230 aa, Escherichia coli DEC4F; identical to SEQ ID NO: 5765

SEQ ID NO: 12192 - protein, 619 aa, Escherichia coli DEC4F
MGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 12193 - protein, 746 aa, Escherichia coli DEC4F; identical to SEQ ID NO: 5761

SEQ ID NO: 12194 - protein, 193 aa, Escherichia coli DEC4F; identical to SEQ ID NO: 5760

SEQ ID NO: 12195 - protein, 243 aa, Escherichia coli DEC4F; identical to SEQ ID NO: 11367

SEQ ID NO: 12196 - protein, 720 aa, Escherichia coli DEC4F; identical to SEQ ID NO: 11368

SEQ ID NO: 12197 - protein, 430 aa, Escherichia coli DEC4F; identical to SEQ ID NO: 5758

SEQ ID NO: 12198 - protein, 760 aa, Escherichia coli DEC4F; identical to SEQ ID NO: 5756

SEQ ID NO: 12199 - protein, 630 aa, Escherichia coli DEC4F
MGAEFSANFKDTDIQEFINTVSKNLHKTVIINPDVQGTITVRSYDMLNEEQYYQFFLSVLDVYGFAVVDMHNGILKVVRSKDAKTSAVPVASDVSPGTGDEVVTRVVPVSNVAARDLAPLLRQLNDNAGAGSVVHYEPSNVLLMTGRAAVMKRLMEIVERVDKVGNRSVATVPLTYASATDVARLVTELTKETDKTAIPAWMTAKLVADERTNSVLVSGEPISQQRIISIIKQLDRQEDVQGNTKVIYLKYAKAKDLVEVLTGISSSIENDSKKSPSTEALRKGVTIKSHEQTNALILTGAPDVIRDLENVISQLDIRRPQVLVEAIIAEIQDADGLNLGIQWVNKHAGVAQFTSTGLPITTMVQTRQNEILDSDQSNALSMFNGIAAGFYQGNWAMLLTALSTSSKNDILATPSIVTLDNMEATFNVGQEVPVLSGSQTTSGDNIFNTVERKTVGIKLRVKPQINEGDSVLLEIEQEVSGVADTAVATTTDLGATFNTRTVTNAMLVGNGETVVVGGLLDKSIRGSESKVPLLGDIPVLGHLFRAKSEQTAKRNLMLFIRPTIIRERDGFRHASAEKYQSFNQEQVQSRGKETTALTLNEEQLRLSPDQDDTAFRKVKAAIAAFYAQEM

SEQ ID NO: 12200 - protein, 998 aa, Escherichia coli DEC4F; identical to SEQ ID NO: 6058

SEQ ID NO: 12201 - protein, 203 aa, Escherichia coli DEC4F; identical to SEQ ID NO: 6414

SEQ ID NO: 12202 - protein, 361 aa, Escherichia coli DEC4F; identical to SEQ ID NO: 11373

SEQ ID NO: 12203 - protein, 233 aa, Escherichia coli DEC4F; identical to SEQ ID NO: 5752

SEQ ID NO: 12204 - protein, 630 aa, Escherichia coli DEC4F; identical to SEQ ID NO: 11690

SEQ ID NO: 12205 - protein, 170 aa, Escherichia coli DEC4F; identical to SEQ ID NO: 11451

SEQ ID NO: 12206 - protein, 459 aa, Escherichia coli DEC4F
MAVKISGVLKDGTGKPVENCTIQLKARRNSATVVVNTVASENPDEAGRYSMDVEYGQYSVILLVEGFPPSHAGTITVYEDSQPGTLNDFLGAMSEDDVRPEALRRFELMVEEAARHAEEAKKNAGEAETSARNAGISASQAEESAANADTSAGDASESARQAAESAAAAKQSEEASSSSASAAAQKASESSQSAAEAELSRKTAESAAGNAARDATTATEKARESAESAQSAEQSRIAAEEAVNRIPTVVGPPGPKGEPGPAGPQGPKGDKGERGDTGPAGATGERGPAGDAGPAGPAGPAGPQGPKGETGAAGPVGATGPQGPKGDPGETQIRFRLGPGNIIETNSHGWFPDTDGALITGLTFLDPKDATRVQVFFSICRSGLVTGRGRMLRGWMKWAVIQAEQENDMNILKKLCSVCAVAESMMTVNTGSRLQYNCDWGRQTSWSQMRMALFRSRTG

SEQ ID NO: 12207 - protein, 89 aa, Escherichia coli DEC4F; identical to SEQ ID NO: 6233

SEQ ID NO: 12208 - protein, 209 aa, Escherichia coli DEC4F; identical to SEQ ID NO: 11379

SEQ ID NO: 12209 - protein, 840 aa, Escherichia coli DEC4F; identical to SEQ ID NO: 11380

SEQ ID NO: 12210 - protein, 233 aa, Escherichia coli DEC4F; identical to SEQ ID NO: 11381

SEQ ID NO: 12211 - protein, 191 aa, Escherichia coli DEC4F; identical to SEQ ID NO: 5748

SEQ ID NO: 12212 - protein, 232 aa, Escherichia coli DEC4F; identical to SEQ ID NO: 5747

SEQ ID NO: 12213 - protein, 729 aa, Escherichia coli DEC4F; identical to SEQ ID NO: 5745

SEQ ID NO: 12214 - protein, 213 aa, Escherichia coli DEC4F; identical to SEQ ID NO: 5744

SEQ ID NO: 12215 - protein, 391 aa, Escherichia coli DEC4F
MAVKISGVLKDGTGKPVENCTIQLKARRTSSTVVVNTVASENPDEAGRYSMDVEYGQYSVILLVEGFPPSHAGTITVYEDSQPGTLNDFLGAMSEDDVRPEALRRFELMVEEAARHAEEAKKNAGEAETSARNAGISASQAEESAANADTSAGDASESARQAAESAAAAKQSEDASSSSASAAAQKASESSQSAAEAELSRKTAESAAGNAARDATTATEKARESAESAQSAEQSRIAAEEAVNRIPTVVGPPGPKGEQGPAGPQGPKGDKGERGDTGPVGATGERGPAGDAGPAGPQGPKGDRGERGETGLTGNAGPQGPKGDTGAAGPAGPQGPKGETGAAGPVGEPDLRDRRATRGRHKSVFVWGRETLLRQTAMAGSRIQMAHSSPD

SEQ ID NO: 12216 - protein, 203 aa, Escherichia coli DEC4F; identical to SEQ ID NO: 6347

SEQ ID NO: 12217 - protein, 656 aa, Escherichia coli DEC4F; identical to SEQ ID NO: 11390

SEQ ID NO: 12218 - protein, 207 aa, Escherichia coli DEC4F; identical to SEQ ID NO: 5743

SEQ ID NO: 12219 - protein, 236 aa, Escherichia coli DEC4F; identical to SEQ ID NO: 11364

SEQ ID NO: 12220 - protein, 883 aa, Escherichia coli DEC4F; identical to SEQ ID NO: 5702

SEQ ID NO: 12221 - protein, 366 aa, Escherichia coli DEC4F; identical to SEQ ID NO: 11362

SEQ ID NO: 12222 - protein, 700 aa, Escherichia coli DEC4F; identical to SEQ ID NO: 5740

SEQ ID NO: 12223 - protein, 551 aa, Escherichia coli DEC4F; identical to SEQ ID NO: 5742

SEQ ID NO: 12224 - protein, 118 aa, Escherichia coli DEC4F [sequence omitted]

SEQ ID NO: 12225 - protein, 191 aa, Escherichia coli DEC4F; identical to SEQ ID NO: 5701

SEQ ID NO: 12226 - protein, 102 aa, Escherichia coli DEC4F; identical to SEQ ID NO: 11707

SEQ ID NO: 12227 - protein, 89 aa, Escherichia coli DEC4F; identical to SEQ ID NO: 6232

SEQ ID NO: 12228 - protein, 715 aa, Escherichia coli DEC4F; identical to SEQ ID NO: 11710

SEQ ID NO: 12229 - protein, 826 aa, Escherichia coli DEC4F; identical to SEQ ID NO: 11397

SEQ ID NO: 12230 - protein, 224 aa, Escherichia coli DEC4F; identical to SEQ ID NO: 11398

SEQ ID NO: 12231 - protein, 627 aa, Escherichia coli DEC4F; identical to SEQ ID NO: 11401

SEQ ID NO: 12232 - protein, 162 aa, Escherichia coli DEC4F; identical to SEQ ID NO: 5734

SEQ ID NO: 12233 - protein, 367 aa, Escherichia coli DEC4F; identical to SEQ ID NO: 5700

SEQ ID NO: 12234 - protein, 200 aa, Escherichia coli DEC4F; identical to SEQ ID NO: 5732

SEQ ID NO: 12235 - protein, 274 aa, Escherichia coli DEC4F; identical to SEQ ID NO: 5731

SEQ ID NO: 12236 - protein, 252 aa, Escherichia coli DEC4F; identical to SEQ ID NO: 11406

SEQ ID NO: 12237 - protein, 860 aa, Escherichia coli DEC4F; identical to SEQ ID NO: 11407

SEQ ID NO: 12238 - protein, 518 aa, Escherichia coli DEC4F; identical to SEQ ID NO: 11400

SEQ ID NO: 12239 - protein, 432 aa, Escherichia coli DEC4F; identical to SEQ ID NO: 5727

SEQ ID NO: 12240 - protein, 567 aa, Escherichia coli DEC4F; identical to SEQ ID NO: 11409

SEQ ID NO: 12241 - protein, 359 aa, Escherichia coli DEC4F; identical to SEQ ID NO: 11410

SEQ ID NO: 12242 - protein, 713 aa, Escherichia coli DEC4F; identical to SEQ ID NO: 11411

SEQ ID NO: 12243 - protein, 231 aa, Escherichia coli DEC4F; identical to SEQ ID NO: 5724

SEQ ID NO: 12244 - protein, 838 aa, Escherichia coli DEC4F; identical to SEQ ID NO: 5723

SEQ ID NO: 12245 - protein, 678 aa, Escherichia coli DEC4F; identical to SEQ ID NO: 5722

SEQ ID NO: 12246 - protein, 108 aa, Escherichia coli DEC4F; identical to SEQ ID NO: 11583

SEQ ID NO: 12247 - protein, 386 aa, Escherichia coli DEC4F; identical to SEQ ID NO: 11415

SEQ ID NO: 12248 - protein, 660 aa, Escherichia coli DEC4F; identical to SEQ ID NO: 6039

SEQ ID NO: 12249 - protein, 367 aa, Escherichia coli DEC4F; identical to SEQ ID NO: 11417

SEQ ID NO: 12250 - protein, 228 aa, Escherichia coli DEC4F; identical to SEQ ID NO: 11499

SEQ ID NO: 12251 - protein, 514 aa, Escherichia coli DEC4F; identical to SEQ ID NO: 11496

SEQ ID NO: 12252 - protein, 208 aa, Escherichia coli DEC4F; identical to SEQ ID NO: 5717

SEQ ID NO: 12253 - protein, 614 aa, Escherichia coli DEC4F; identical to SEQ ID NO: 5715

SEQ ID NO: 12254 - protein, 446 aa, Escherichia coli DEC4F; identical to SEQ ID NO: 5714

SEQ ID NO: 12255 - protein, 237 aa, Escherichia coli DEC4F; identical to SEQ ID NO: 5713

SEQ ID NO: 12256 - protein, 478 aa, Escherichia coli DEC4F; identical to SEQ ID NO: 5711

SEQ ID NO: 12257 - protein, 368 aa, Escherichia coli DEC4F; identical to SEQ ID NO: 11425

SEQ ID NO: 12258 - protein, 216 aa, Escherichia coli DEC4F
MAMMVAGRAEAGVALGATRIIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 12259 - protein, 878 aa, Escherichia coli DEC4F; identical to SEQ ID NO: 5707

SEQ ID NO: 12260 - protein, 208 aa, Escherichia coli DEC4F
MVIYGTRIIYPEKNREVLVQLMNQSKNASLIQAWIDDGNTTIAPEKIQVTFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSHNDITLKNNHASEYELTVVDDYGNNIHSKIAAR

SEQ ID NO: 12261 - protein, 784 aa, Escherichia coli DEC4F; identical to SEQ ID NO: 5705

SEQ ID NO: 12262 - protein, 170 aa, Escherichia coli DEC4F; identical to SEQ ID NO: 5855

SEQ ID NO: 12263 - protein, 241 aa, Escherichia coli DEC4F; identical to SEQ ID NO: 11431

SEQ ID NO: 12264 - protein, 747 aa, Escherichia coli DEC4F; identical to SEQ ID NO: 5774

SEQ ID NO: 12265 - protein, 161 aa, Escherichia coli DEC4F; identical to SEQ ID NO: 5769

SEQ ID NO: 12266 - protein, 266 aa, Escherichia coli DEC4F; identical to SEQ ID NO: 5771

SEQ ID NO: 12267 - protein, 747 aa, Escherichia coli DEC5A; identical to SEQ ID NO: 5775

SEQ ID NO: 12268 - protein, 266 aa, Escherichia coli DEC5A; identical to SEQ ID NO: 5772

SEQ ID NO: 12269 - protein, 161 aa, Escherichia coli DEC5A; identical to SEQ ID NO: 5769

SEQ ID NO: 12270 - protein, 170 aa, Escherichia coli DEC5A; identical to SEQ ID NO: 5855

SEQ ID NO: 12271 - protein, 228 aa, Escherichia coli DEC5A
MSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRLSGLQGEPAEAPAKITWKLNNAQLQANNPTPYYVSFNEVKLESGGKTYNVNSSMVTPFSQASFGVTGLPGSVSSGKVVFKAINDFGGNIDGSATF

SEQ ID NO: 12272 - protein, 222 aa, Escherichia coli DEC5A
MLIIFYLIISASVHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSLMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 12273 - protein, 869 aa, Escherichia coli DEC5A
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGVPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGVIIYQSYVSPGAFEITDLHPTSSNGDLDVTIDERDGNQQNYTIPYSTVPILQREGRFKFDLTAGDFRSSNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVCANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 12274 - protein, 351 aa, Escherichia coli DEC5A; identical to SEQ ID NO: 5767

SEQ ID NO: 12275 - protein, 746 aa, Escherichia coli DEC5A; identical to SEQ ID NO: 5761

SEQ ID NO: 12276 - protein, 193 aa, Escherichia coli DEC5A; identical to SEQ ID NO: 5760

SEQ ID NO: 12277 - protein, 203 aa, Escherichia coli DEC5A; identical to SEQ ID NO: 6414

SEQ ID NO: 12278 - protein, 361 aa, Escherichia coli DEC5A; identical to SEQ ID NO: 11373

SEQ ID NO: 12279 - protein, 224 aa, Escherichia coli DEC5A; identical to SEQ ID NO: 11374

SEQ ID NO: 12280 - protein, 630 aa, Escherichia coli DEC5A; identical to SEQ ID NO: 11764

SEQ ID NO: 12281 - protein, 226 aa, Escherichia coli DEC5A
MIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRKSQGVQLTNPTPYYINLIQVSVNGKALSNVGVVPPKSQRQTSWCQAIAPCHVAWRAINDYGGLSAKKEQNLP

SEQ ID NO: 12282 - protein, 209 aa, Escherichia coli DEC5A; identical to SEQ ID NO: 11379

SEQ ID NO: 12283 - protein, 840 aa, Escherichia coli DEC5A; identical to SEQ ID NO: 11380

SEQ ID NO: 12284 - protein, 233 aa, Escherichia coli DEC5A; identical to SEQ ID NO: 11381

SEQ ID NO: 12285 - protein, 178 aa, Escherichia coli DEC5A; identical to SEQ ID NO: 8815

SEQ ID NO: 12286 - protein, 232 aa, Escherichia coli DEC5A; identical to SEQ ID NO: 5747

SEQ ID NO: 12287 - protein, 729 aa, Escherichia coli DEC5A; identical to SEQ ID NO: 5745

SEQ ID NO: 12288 - protein, 213 aa, Escherichia coli DEC5A; identical to SEQ ID NO: 5744

SEQ ID NO: 12289 - protein, 331 aa, Escherichia coli DEC5A; identical to SEQ ID NO: 6551

SEQ ID NO: 12290 - protein, 760 aa, Escherichia coli DEC5A
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTATLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTASIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDEGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 12291 - protein, 203 aa, Escherichia coli DEC5A; identical to SEQ ID NO: 6347

SEQ ID NO: 12292 - protein, 656 aa, Escherichia coli DEC5A; identical to SEQ ID NO: 11774

SEQ ID NO: 12293 - protein, 207 aa, Escherichia coli DEC5A; identical to SEQ ID NO: 5743

SEQ ID NO: 12294 - protein, 407 aa, Escherichia coli DEC5A
MTERELSIIRALGEEFATVLADLQRTFEEKMAAQAQAFEEKLASLSAVLQKHVTVDEVHPVLQAMVDDAVGTIPVPRDGRDYDPDVLQQAVNDAVANIPVPADGKSITPDDVRPMLEQMVKEAVSHIPAPRDGRDYDPEVLKQVVNDAVGSIPVPADGKSLTPDDVRPMLEQMVKEAVSHIPVPRDGRDYDPEVLKQAVNDAVAKIPVPADGKSITPDDVRPMLEQMVKEAVSHIPAPRDGRDYDPDVLRKAVLEAVNALPAPQDGRDATALEVLPAIDDQKSFPRGTYATHLGGFWRAYEKTHGMRGWECLVDGVADIDVSMTGERLFSVVIRHSSGQRTEKTFSLPVMLYRGVFRAGETYHPGDTVTWGGSLWHCNSMTGDKPGEAHSSGWTLAAKRGRDAGGGK

SEQ ID NO: 12295 - protein, 551 aa, Escherichia coli DEC5A; identical to SEQ ID NO: 5742

SEQ ID NO: 12296 - protein, 700 aa, Escherichia coli DEC5A; identical to SEQ ID NO: 5740

SEQ ID NO: 12297 - protein, 366 aa, Escherichia coli DEC5A
MKLKIVAVVVTGLLAANVAHAAEVYNKDGNKLDLYGKVTALRYFTDDKRDDGDKTYVRLGFKGETQINDQMIGFGHWEYDFKGYNDEANGSRDNKTRLAYAGLKISEFGSLDYGRNYGVGYDIGSWTDMLPEFGGDTWSQKDVFMTYRTTGVATYRNYDFFGLIEGLNFAAQYQGKNERTDNSHLYGADYTRANGDGFGISSTYVYDGFGIGAVYTKSDRTNAQERAAANPLNASGKNAELWATGIKYDANNIYFAANYAETLNMTTYGDGYISNKAQSFEVVAQYQFDFGLHPSLAYLKSKGIDLGRYGDQDMIEYIDVGATYFFNKNMSTYVDYKINLIDESDFTRAVDIRTDNIVATGITYQF

SEQ ID NO: 12298 - protein, 871 aa, Escherichia coli DEC5A
MHQVLLLPRFARLTIALSLATAVFPVDAEYYFNPRFLSNDLAESVDLSAFTKGREAPPGTYRVDIYLNDEFMTSRDITFITDDNNADLIPCLSTDLLVSLGIKKSALLDNKEHSAEKHVPDNSACTPLQDRLVDASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPRFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSTLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 12299 - protein, 239 aa, Escherichia coli DEC5A
MHQMQTTRTPYSISFMATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSNLTLINPTPYFITVTNMKAGNSNLPNTMVPPKGEVSVDIPHAATGDISFQTINDYGALTPRIKATMQ

SEQ ID NO: 12300 - protein, 111 aa, Escherichia coli DEC5A; identical to SEQ ID NO: 5738

SEQ ID NO: 12301 - protein, 118 aa, Escherichia coli DEC5A [sequence omitted]

SEQ ID NO: 12302 - protein, 395 aa, Escherichia coli DEC5A
MKRKVLAMLVPALLVAGAANAAEIYNKDGNKLDLYGKVAGLHYFSDDASSDGDMSYARIGFKGETQIADQFTGYGQWEFNIGANGPESDKGNTATRLAFAGFGFGQNGTFDYGRNYGVVYDVEAWTDMLPEFGGDTYAGADNFMNGRANSVATYRNNGFFGQVDGLNFALQYQGNNEKSGLFDQEGSGNGNGRKLAKENGDGYGMSTSYDFDFGLSLGAAYSNSDRTDNQVHKGTHNTRYGDRFDATAGGETAEAWTVGAKYDANNVYLAAMYAETRNMTGYGDADAIANKTQNFEVVAQYQFDFGLRPSIAYLQSKGKDLGGVNSDNFDSQGNHHYTNKDLVKYVDIGMTYYFNKNMSTYVDYKINLLDNDDDFYKENGIATDDIVAVGLVYQF

SEQ ID NO: 12303 - protein, 715 aa, Escherichia coli DEC5A; identical to SEQ ID NO: 11710

SEQ ID NO: 12304 - protein, 213 aa, Escherichia coli DEC5A
MVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWYLTIIDDHGNYISDKI

SEQ ID NO: 12305 - protein, 637 aa, Escherichia coli DEC5A
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNINKARIQGVETELKIPFNDEWKLSLNYTYNDGRDVSNGENKPLSDLPFHTANGTLDWKPLTLEDWSFYVSGHYTGQKRADSATAKTPGGYTIWNTGAAWQVTKDVKLRAGVLNLGDKDLSRDDYSYNEDGRRYFMAVDYRF

SEQ ID NO: 12306 - protein, 162 aa, Escherichia coli DEC5A; identical to SEQ ID NO: 5734

SEQ ID NO: 12307 - protein, 367 aa, Escherichia coli DEC5A; identical to SEQ ID NO: 5700

SEQ ID NO: 12308 - protein, 274 aa, Escherichia coli DEC5A; identical to SEQ ID NO: 5730

SEQ ID NO: 12309 - protein, 252 aa, Escherichia coli DEC5A
MTNLFCSARTAATTLALLITAASLSVQASVTPDRTRLIFNESDKSISVTLRNNDPKMPYLAQSWMEDGQGNRISSPLTVLPPVQRIDSMMNGQVKVQGMPDINKLPADRESVFYFNVREIPPKSNKPNTLQIALQTRIKLFWRPKALENVSMKNPWQHKVTLTRSGQEFTVNNPTPYFVVISNASAQKNGNPAAGFSPMVISPKTSVPLKVKMDSVPVLTYVNDYGARLPLFFRCTGNTCQVDEEQNSKGQG

SEQ ID NO: 12310 - protein, 860 aa, Escherichia coli DEC5A
MSGSYVNAWAENEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDITHSHTRLDKETAYGKGSLDGNSFRLSYSKDFDELNSRVTFAGYRFSEENFMTMSEYLDASDSEMVRTGNDKEMYTATYNQNFRDAGVSVYLNYTGHTYWDRDEQTNYNVMLSHYFNLGSIRNMSISMTGYRYEYDNQADKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQATLTEGAIGYRKFSVISGQKAMAVLRLQDGSYPPFGAEVKNDSAQNVGLVDDDGNVYLAGVKPGEHMIVSWGGVAHCDIHLPDPLPADLFNGLLLPCQQTGAISPSMPHEIKPVIQEQTQQVMPTEAPVSVSAN

SEQ ID NO: 12311 - protein, 518 aa, Escherichia coli DEC5A; identical to SEQ ID NO: 6358

SEQ ID NO: 12312 - protein, 567 aa, Escherichia coli DEC5A
MKIKLRITIILISVLCIFNGLLTPGAYAAAANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGDGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNIDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 12313 - protein, 359 aa, Escherichia coli DEC5A; identical to SEQ ID NO: 11410

SEQ ID NO: 12314 - protein, 432 aa, Escherichia coli DEC5A
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKALGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 12315 - protein, 651 aa, Escherichia coli DEC5A
MNGRLSVFVFTTVFLSAIPGWGAEFSASFKDTDIQEFINTVSKNLHKTVIINPDVQGTITVRSYDMLNEEQYYQFFLSVLDVYGFAVVDMHNGILKVVRSKDAKTSAVPVASDASPGTGDEVVTRVVPVSNVAARDLAPLLRQLNDNAGAGSVVHYEPSNVLLMTGRAAVMKRLMEIVERVDKEGNRSVATVPLTYASATDVARLVTELTKESDKTAMPAWMTAKLVADERTNSVLVSGEPISQQRIISMIKQLDRKEDVQGNTKVIYLKYAKAKDLVEVLTGISSNIENDAKKSSSTEALRKGVTIKSHEQTNALILTGAPDVIRDLENVISQLDIRRPQVLVEAIIAEVQDADGLNLGIQWVNKHSGVTQFTSTGLPITTMVQTRQSDISDSDQSNTLSMFNGIAAGFYQGNWAMLLTALSTSSKNDILATPSIVTLDNMEATFNVGQEVPVLSGSQTTSGDNIFNTVERKTVGIKLRVKPQINEGDSVLLEIEQEVSGVADTAVATTTDLGATFNTRTVTNAMLVGNGETVVVGGLLDKSIRGSESKVPLLGDIPVLGHLFSSKSEHAAKRNLMLFIRPTIIRERDGFRHASAEKYLSFNQEQVQSRGKETMALTLNEEQLKLSRDRDDTTFRKVKTAIAAFYARGMQ

SEQ ID NO: 12316 - protein, 94 aa, Escherichia coli DEC5A
MLRLARAVIPAAVLMMFFPQLAMVAGSSGQDLMASGNTTVKATFGKDSSVVKWVVLAEVLVGAVMYMMTKNVKFLAGFAIISVFIAVGMAVVGL

SEQ ID NO: 12317 - protein, 686 aa, Escherichia coli DEC5A; identical to SEQ ID NO: 6339

SEQ ID NO: 12318 - protein, 689 aa, Escherichia coli DEC5A; identical to SEQ ID NO: 11798

SEQ ID NO: 12319 - protein, 199 aa, Escherichia coli DEC5A
MIYDASRKEAALPVANKGAETPYLLQSWVDNIDGTSRAPFIITPPLIRLEAGDDSSLRIIKTADNLPENKESLFYINVRAIPAKKKSDDVNANELTLVFKTRIKMFYRPAHLKGRVSDAWKSLEFKRSDHSLNIYNPTEYYVVFAGLAVDKADLTSKIEYIAPGEHKQLPLPASGGKNVKWAAINDYGGSSGTETRPLQ

SEQ ID NO: 12320 - protein, 838 aa, Escherichia coli DEC5A
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYNFTGVQLASDDNILPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 12321 - protein, 386 aa, Escherichia coli DEC5A; identical to SEQ ID NO: 11415

SEQ ID NO: 12322 - protein, 629 aa, Escherichia coli DEC5A; identical to SEQ ID NO: 11941

SEQ ID NO: 12323 - protein, 814 aa, Escherichia coli DEC5A
MGQHVDLTMFEKGQEQQLPGIYRVSVYVNEQRMETRTLEFKEATEAQRKAMGESLVPCLSRTQLAEMGVRVESFPALNLVSAEACVPFDEIIPLASSHFDFSEQKLVLSFPQAAMHQVARGTVPESLWDEGIPALLLDYSFSGSNSEYDSTGSSSSYVDDNGTVHHDDGKDTLKSDSYYLNLRSGLNLGAWRLRNYSTWSHSGGKAQWDNIGTSLSRAIIPFKAQLTMGDTATAGDIFDSVQMRGAMLASDEEMLPDSQRGFAPIVRGIAKSNAEVSIEQNGYVIYRTYVQPGAFEINDLYPTANSGDLTVIIKEADGSEQRFIQPFSSVPIFQREGHLKYSFAAGEYQAGNYDSASPRFGQLDLIYGLPWGMTAYGGVLISNNYNAFALGIGKNFGYIGAISIDVTQAKSELNNDRDSQGQSYRFLYSKSFESGTDFRLAGYRYSTSGFYTFQEATDVRSDADSDYNRYHKRSEIQGNLTQQLGAYGSVYLNLTQQDYWNDAGKQNTVSAGYNGRIGKVSYSIAYSWNKSPEWDESDRLWSFNISVPLGRAWSNYRVTTDQDGRTNQQVGVSGTLLEDRNLSYSVQEGYASNGVGNSGNANVGYQGGSGNVNVGYSYGKDYRQLNYSVRGGVIVHSEGVTLSQPLGETMTLISVPGARNARVVNNGGVQVDWMGNAIVPYAMPYRENEISLRSDSLGDDVDVENAFQKVVPTRGAIVRARFDTRVGYRVLMTLLRSAGSPVPFGATATLITDKQNEVSSIVGEEGQLYISGMPEEGRVLIKWGNDASQQCVAPYKLSLELKQGGIIPVSANCQ

SEQ ID NO: 12324 - protein, 229 aa, Escherichia coli DEC5A; identical to SEQ ID NO: 11418

SEQ ID NO: 12325 - protein, 125 aa, Escherichia coli DEC5A; identical to SEQ ID NO: 11420

SEQ ID NO: 12326 - protein, 512 aa, Escherichia coli DEC5A; identical to SEQ ID NO: 5948

SEQ ID NO: 12327 - protein, 208 aa, Escherichia coli DEC5A; identical to SEQ ID NO: 5717

SEQ ID NO: 12328 - protein, 614 aa, Escherichia coli DEC5A; identical to SEQ ID NO: 5716

SEQ ID NO: 12329 - protein, 446 aa, Escherichia coli DEC5A; identical to SEQ ID NO: 5714

SEQ ID NO: 12330 - protein, 237 aa, Escherichia coli DEC5A
MRKITQAISAVCLLFALNSSAVALASSPSPLNPGTNVARLAEQAPIHWVSVAQIENSLAGRPPMAVGFDIDDTVLFSSPGFWRGKKNFSPESEDYLKNPVFWEKMNNGWDEFSIPKEVARQLIDMHVRRGDAIFFVTGRSPTKTETVSKTLADNFHIPATSMNPVIFAGDKPGQNTKSQWLQDKNIRIFYGDSDNDITAARDVGARGIRILRASNSTYKPLPKAGAFGEEVIVNSEY

SEQ ID NO: 12331 - protein, 478 aa, Escherichia coli DEC5A; identical to SEQ ID NO: 5711

SEQ ID NO: 12332 - protein, 774 aa, Escherichia coli DEC5A
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNSNTVKESADGSTGRIPGFMLWGARVAYDFGPQMADLNLAFGVKNIFDQDYFIRSYNDNNKGIYAGQPRTLYMQGSLKF

SEQ ID NO: 12333 - protein, 241 aa, Escherichia coli DEC5A; identical to SEQ ID NO: 5709

SEQ ID NO: 12334 - protein, 863 aa, Escherichia coli DEC5A
MHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 12335 - protein, 219 aa, Escherichia coli DEC5A; identical to SEQ ID NO: 11509

SEQ ID NO: 12336 - protein, 243 aa, Escherichia coli DEC5A; identical to SEQ ID NO: 8524

SEQ ID NO: 12337 - protein, 816 aa, Escherichia coli DEC5A
MNIYRLSVLSCLAMVTPPALTAEFNLNVLDKSIRDSVDISLLNQKGVVAPGDYFVSVTVNNNKISNGQQIRWQKSGDKIIPCINESLIELFGLKSDFRKKLPAIKECVDFSVFPEIIFTFDQANQQLNITIPQAWLAWHSENWTPPSTWNNGIPGFLMDYNLFASTYRPQSGSSSNNLNAYGTTGLNAGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLAAGRPRSSMSHHTEDETFISHEVSWGMLSNTSLYGGMLLAGDDYRSGALGIGQNMLWMGALSFDVTWADSHFDTQQDEQGYSYRFNYSKQVDATNSTISLAAYRFSDRHFHSYANYIDHKYNDADAQDEKQTISLSFGQPITLLNLNLYANILHQSWWNADTSTTANITVGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGAAFHRRSSTNEPRLMVSTDGVGDIPIQGNIDYTNRFGIAVVPFVSSYQPTTVAVNMNDLPDGVTVSENVVKETWTEGAIGFKSLASRAGKDLNVIISDANGHFPPLGADVRQAEGGVSVGMVGENGHAWLSGVDENQQFTVHWGDQKTCAIHLPEHLEDVTKRLILPCN

SEQ ID NO: 12338 - protein, 430 aa, Escherichia coli DEC5A; identical to SEQ ID NO: 5758

SEQ ID NO: 12339 - protein, 170 aa, Escherichia coli DEC5B; identical to SEQ ID NO: 5855

SEQ ID NO: 12340 - protein, 241 aa, Escherichia coli DEC5B
MFPLVKKTVSALFVSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRPSGLQGEPAEAPAKITWKLNNAQLQANNPTPYYVSFNEVKLESGGKTYNVNSSMVTPFSQASFGVTGLPGSVSSGKVVFKAINDFGGNIDGSATF

SEQ ID NO: 12341 - protein, 747 aa, Escherichia coli DEC5B
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKDHYLARKYVVDDEKLQNFSVDTQLQSKFATGDIDHTLLTGVDFMRMRNDINAWFGYDDSVPLLDLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 12342 - protein, 266 aa, Escherichia coli DEC5B; identical to SEQ ID NO: 5772

SEQ ID NO: 12343 - protein, 161 aa, Escherichia coli DEC5B; identical to SEQ ID NO: 5769

SEQ ID NO: 12344 - protein, 368 aa, Escherichia coli DEC5B; identical to SEQ ID NO: 11425

SEQ ID NO: 12345 - protein, 241 aa, Escherichia coli DEC5B; identical to SEQ ID NO: 5709

SEQ ID NO: 12346 - protein, 837 aa, Escherichia coli DEC5B
MSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPSESQQQLLTQLSAECR

SEQ ID NO: 12347 - protein, 461 aa, Escherichia coli DEC5B
MLRTTRWVAAIIFLYSFPGYAEETFDTHFMIGGMKGEKVSEYHFDNKQPLPGNYELDFYVNNQWRGKQDITIPESPVKPCLPKVLLTKLGVKTGNLNTEDNCILLDKAVHGGQYQWDISEHRLNLTVPQAYINELERGYVPPESWDRGIDAFYTSYNLSQYRSYDSNNNSNTASYGRFNSGLNLFSWQLHSDASYSKPDDMKGTWQSNTLYLEHGWSQILSTVQIGENYTSSLIFDSLRFSGIRLFRDMQMLPDSMQSFTPLVQGVAQSNALITVSQNGYIIYQKEVPPGPFTIADLQLSGSGSDLDVSIKEADGSVRSFLVPYSSVPNMLQPGISNFDFIAGRSKIYGVKNQEDFLEANYIYGLNNLLTLYGGTILSDNYNAITLGNGWNTPLGAISFDATRSSSKLNNDITHEGTSYQVAYNKYLVQTATRFSVAAWRYASQDYRTLDLPLYFQTSVIT

SEQ ID NO: 12348 - protein, 227 aa, Escherichia coli DEC5B; identical to SEQ ID NO: 11429

SEQ ID NO: 12349 - protein, 351 aa, Escherichia coli DEC5B; identical to SEQ ID NO: 5767

SEQ ID NO: 12350 - protein, 230 aa, Escherichia coli DEC5B; identical to SEQ ID NO: 5765

SEQ ID NO: 12351 - protein, 869 aa, Escherichia coli DEC5B
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGVPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 12352 - protein, 746 aa, Escherichia coli DEC5B; identical to SEQ ID NO: 5761

SEQ ID NO: 12353 - protein, 193 aa, Escherichia coli DEC5B; identical to SEQ ID NO: 5760

SEQ ID NO: 12354 - protein, 243 aa, Escherichia coli DEC5B; identical to SEQ ID NO: 8524

SEQ ID NO: 12355 - protein, 816 aa, Escherichia coli DEC5B
MNIYRLSVLSCLAMVTPPALTAEFNLNVLDKSIRDSVDISLLNQKGVVAPGDYFVSVTVNNNKISNGQQIRWQKSGDKIIPCINESLIELFGLKSDFRKKLPAIKECVDFSVFPEIIFTFDQANQQLNITIPQAWLAWHSENWTPPSTWNNGIPGFLMDYNLFASTYRPQSGSSSNNLNAYGTTGLNTGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLAAGRPRSSMSHHTEDETFISHEVSWGMLSNTSLYGGMLLAGDDYRSGALGIGQNMLWMGALSFDVTWADSHFDTQQDEQGYSYRFNYSKQVDATNSTISLAAYRFSDRHFHSYANYIDHKYNDADAQDEKQTISLSFGQPITLLNLNLYANILHQSWWNADTSTTANITVGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGAAFHRRSSTNEPRLMVSTDGVGDIPIQGNIDYTNRFGIAVVPFVSSYQPTTVAVNMNDLPDGVTVSENVVKETWTEGAIGFKSLASRAGKDLNVIISDANGHFPPLGADVRQAEGGVSVGMVGENGHAWLSGVDENQQFTVHWGDQKTCAIHLPEHLEDVTKRLILPCH

SEQ ID NO: 12356 - protein, 430 aa, Escherichia coli DEC5B; identical to SEQ ID NO: 5758

SEQ ID NO: 12357 - protein, 224 aa, Escherichia coli DEC5B; identical to SEQ ID NO: 11374

SEQ ID NO: 12358 - protein, 630 aa, Escherichia coli DEC5B; identical to SEQ ID NO: 11764

SEQ ID NO: 12359 - protein, 226 aa, Escherichia coli DEC5B; identical to SEQ ID NO: 12281

SEQ ID NO: 12360 - protein, 209 aa, Escherichia coli DEC5B; identical to SEQ ID NO: 11379

SEQ ID NO: 12361 - protein, 840 aa, Escherichia coli DEC5B; identical to SEQ ID NO: 11380

SEQ ID NO: 12362 - protein, 233 aa, Escherichia coli DEC5B; identical to SEQ ID NO: 11381

SEQ ID NO: 12363 - protein, 191 aa, Escherichia coli DEC5B; identical to SEQ ID NO: 5748

SEQ ID NO: 12364 - protein, 232 aa, Escherichia coli DEC5B; identical to SEQ ID NO: 5747

SEQ ID NO: 12365 - protein, 729 aa, Escherichia coli DEC5B; identical to SEQ ID NO: 5745

SEQ ID NO: 12366 - protein, 213 aa, Escherichia coli DEC5B; identical to SEQ ID NO: 5744

SEQ ID NO: 12367 - protein, 203 aa, Escherichia coli DEC5B; identical to SEQ ID NO: 6347

SEQ ID NO: 12368 - protein, 656 aa, Escherichia coli DEC5B; identical to SEQ ID NO: 11774

SEQ ID NO: 12369 - protein, 207 aa, Escherichia coli DEC5B; identical to SEQ ID NO: 5743

SEQ ID NO: 12370 - protein, 331 aa, Escherichia coli DEC5B; identical to SEQ ID NO: 6551

SEQ ID NO: 12371 - protein, 760 aa, Escherichia coli DEC5B; identical to SEQ ID NO: 5756

SEQ ID NO: 12372 - protein, 203 aa, Escherichia coli DEC5B; identical to SEQ ID NO: 6414

SEQ ID NO: 12373 - protein, 361 aa, Escherichia coli DEC5B
MKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQLLGNGKKAEQWATGLKYDANNIYLAANYGETRNATPITNKFTNISGFANKTQDVLLVAQYQFDFGLRPSIAYTKSKAKDVEGIGDVDLVNYFEVGATYYFNKNMSTYVDYIINQIDSDNKLGVASDDTVAVGIVYQF

SEQ ID NO: 12374 - protein, 539 aa, Escherichia coli DEC5B; identical to SEQ ID NO: 6525

SEQ ID NO: 12375 - protein, 700 aa, Escherichia coli DEC5B
MKIVFVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSSRDDMSVMMYAGERETTQYQSIPMAPQLNPSHAGSVITLQRHDQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGMEARYMGDIMADDENTAKAPSYTLVGLFTGYKYNYHNLTVDLFGRVDNLFDKEYVGSVIVNESNGRYYEPAPGRNYGVGVNIAWRFE

SEQ ID NO: 12376 - protein, 366 aa, Escherichia coli DEC5B; identical to SEQ ID NO: 11362

SEQ ID NO: 12377 - protein, 236 aa, Escherichia coli DEC5B; identical to SEQ ID NO: 11364

SEQ ID NO: 12378 - protein, 118 aa, Escherichia coli DEC5B [sequence omitted]

SEQ ID NO: 12379 - protein, 111 aa, Escherichia coli DEC5B; identical to SEQ ID NO: 5738

SEQ ID NO: 12380 - protein, 394 aa, Escherichia coli DEC5B
MKRKVLAMLVPALLVAGAANAAEIYNKDGNKLDLYGKVAGLHYFSDDASSDGDMSYARIGFKGETQIADQFTGYGQWEFNIGANGPESDKGNTATRLAFAGFGFGQNGTFDYGRNYGVVYDVEAWTDMLPEFGGDTYAGADNFMNGRANSVATYRNNGFFGQVDGLNFALQYQGNNEKSGLFDQEGSGNGNGRKLAKENGDGYGMSTSYDFDFGLSLGAAYSNSDRTDNQVHKGTHNTRYGDRFDATAGGETAEAWTVGAKYDANNVYLAAMYAETRNMTGYGDADAIANKTQNFEVVAQYQFDFGLRPSIAYLQSKGKDLGGVNSDNFDSQGNHHYTNKDLVKYVDIGMTYYFNKNMSTYVDYKINLLDNDDFYKENGIATDDIVAVGLVYQF

SEQ ID NO: 12381 - protein, 224 aa, Escherichia coli DEC5B; identical to SEQ ID NO: 6435

SEQ ID NO: 12382 - protein, 627 aa, Escherichia coli DEC5B; identical to SEQ ID NO: 11401

SEQ ID NO: 12383 - protein, 162 aa, Escherichia coli DEC5B; identical to SEQ ID NO: 5734

SEQ ID NO: 12384 - protein, 367 aa, Escherichia coli DEC5B
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYQFDFGLRPSLAYLQSKGKNLGVINSRNYDDEDILKYVDVGATYYFNKNMSTYVDYKINLLDDNQFTRDAGINTDNIVALGLVYQF

SEQ ID NO: 12385 - protein, 200 aa, Escherichia coli DEC5B; identical to SEQ ID NO: 5732

SEQ ID NO: 12386 - protein, 274 aa, Escherichia coli DEC5B; identical to SEQ ID NO: 5730

SEQ ID NO: 12387 - protein, 252 aa, Escherichia coli DEC5B; identical to SEQ ID NO: 12309

SEQ ID NO: 12388 - protein, 860 aa, Escherichia coli DEC5B; identical to SEQ ID NO: 11720

SEQ ID NO: 12389 - protein, 518 aa, Escherichia coli DEC5B; identical to SEQ ID NO: 6358

SEQ ID NO: 12390 - protein, 432 aa, Escherichia coli DEC5B; identical to SEQ ID NO: 5727

SEQ ID NO: 12391 - protein, 567 aa, Escherichia coli DEC5B
MKIKLRITIILISVLCIFNGLLTPGAYAAAANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGDGNGTFYVSGPPVYVDLVVNAAKLMEQNSDGIEIGRNKVGIIHLVNTFVNDRTYELRGEKIVIPSMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 12392 - protein, 359 aa, Escherichia coli DEC5B; identical to SEQ ID NO: 11410

SEQ ID NO: 12393 - protein, 121 aa, Escherichia coli DEC5B; identical to SEQ ID NO: 6059

SEQ ID NO: 12394 - protein, 686 aa, Escherichia coli DEC5B; identical to SEQ ID NO: 6339

SEQ ID NO: 12395 - protein, 713 aa, Escherichia coli DEC5B; identical to SEQ ID NO: 11726

SEQ ID NO: 12396 - protein, 224 aa, Escherichia coli DEC5B; identical to SEQ ID NO: 11649

SEQ ID NO: 12397 - protein, 838 aa, Escherichia coli DEC5B
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYNFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQCIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTISVLQGTAQCH

SEQ ID NO: 12398 - protein, 678 aa, Escherichia coli DEC5B; identical to SEQ ID NO: 5722

SEQ ID NO: 12399 - protein, 386 aa, Escherichia coli DEC5B; identical to SEQ ID NO: 11415

SEQ ID NO: 12400 - protein, 660 aa, Escherichia coli DEC5B; identical to SEQ ID NO: 11731

SEQ ID NO: 12401 - protein, 857 aa, Escherichia coli DEC5B
MSRKTVSRTFSSFSISVVAVAVASTFSAHAGKFNPKFLEDVQGVGQHVDLTMFEKGQEQQLPGIYRVSVYVNEQRMETRTLEFKEATEAQRKAMGESLVPCLSRTQLAEMGVRVESFPALNLVSAEACVPFDEIIPLASSHFDFSEQKLVLSFPQAAMHQVARGTVPESLWDEGIPALLLDYSFSGSNSEYDSTGSSSSYVDDNGTVHHDDGKDTLKSDSYYLNLRSGLNLGAWRLRNYSTWSHSGGKAQWDNIGTSLSRAIIPFKAQLTMGDTATAGDIFDSVQMRGAMLASDEEMLPDSQRGFAPIVRGIAKSNAEVSIEQNGYVIYRTYVQPGAFEINDLYPTANSGDLTVIIKEADGSEQRFIQPFSSVPIFQREGHLKYSFAAGEYQAGNYDSASPRFGQLDLIYGLPWGMTAYGGVLISNNYNAFALGIGKNFGYIGAISIDVTQAKSELNNDRDSQGQSYRFLYSKSFESGTDFRLAGYRYSTSGFYTFQEATDVRSDADSDYNRYHKRSEIQGNLTQQLGAYGSVYLNLTQQDYWNDAGKQNTVSAGYNGRIGKVSYSIAYSWNKSPEWDESDRLWSFNISVPLGRAWSNYRVTTDQDGRTNQQVGVSGTLLEDRNLSYSVQEGYASNGVGNSGNANVGYQGGSGNVNVGYSYGKDYRQLNYSVRGGVIVHSEGVTLSQPLGETMTLISVPGARNARVVNNGGVQVDWMGNAIVPYAMPYRENEISLRSDSLGDDVDVENAFQKVVPTRGAIVRARFDTRVGYRVLMTLLRSAGSPVPFGATATLITDKQNEVSSIVGEEGQLYISGMPEEGRVLIKWGNDASQQCVAPYKLSLELKQGGIIPVSANCQ

SEQ ID NO: 12402 - protein, 228 aa, Escherichia coli DEC5B
MKSKFVALALSLFLSQSVLAGGVGLSSTRVIYDGSKKEASLTVQNKSKTEEFLIQSWVDDAAGSKKTPFIITPPLFKLDPEKNNILRIVNITPGLPQDRESVYWVNVKAIPSKSDDSENKNVLQIAVRTRIKLFYRPAGLKGDVKTAPNELRFTRNGNQLRVDNPTVFNITFNQFFANDKEIEKAGMVPAKGALNITLPAGVGSVSKIKYNTINDFRSSAEMITKNVD

SEQ ID NO: 12403 - protein, 512 aa, Escherichia coli DEC5B; identical to SEQ ID NO: 5948

SEQ ID NO: 12404 - protein, 125 aa, Escherichia coli DEC5B; identical to SEQ ID NO: 11420

SEQ ID NO: 12405 - protein, 208 aa, Escherichia coli DEC5B; identical to SEQ ID NO: 5717

SEQ ID NO: 12406 - protein, 614 aa, Escherichia coli DEC5B; identical to SEQ ID NO: 5716

SEQ ID NO: 12407 - protein, 446 aa, Escherichia coli DEC5B; identical to SEQ ID NO: 5714

SEQ ID NO: 12408 - protein, 237 aa, Escherichia coli DEC5B; identical to SEQ ID NO: 5713

SEQ ID NO: 12409 - protein, 478 aa, Escherichia coli DEC5B
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAVLQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 12410 - protein, 651 aa, Escherichia coli DEC5C; identical to SEQ ID NO: 12315

SEQ ID NO: 12411 - protein, 94 aa, Escherichia coli DEC5C; identical to SEQ ID NO: 12316

SEQ ID NO: 12412 - protein, 816 aa, Escherichia coli DEC5C; identical to SEQ ID NO: 11428

SEQ ID NO: 12413 - protein, 227 aa, Escherichia coli DEC5C; identical to SEQ ID NO: 11429

SEQ ID NO: 12414 - protein, 170 aa, Escherichia coli DEC5C; identical to SEQ ID NO: 5855

SEQ ID NO: 12415 - protein, 241 aa, Escherichia coli DEC5C
MFPLVKKTVSALFVSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRLSGLQGEPAEAPAKITWKLNNAQLQANNPTPYYVSFNEVKLESGGKTYNVNSSMVTPFSQASFGVTGLPGSVSSGKVVFKAINDFGGNIDGSATF

SEQ ID NO: 12416 - protein, 747 aa, Escherichia coli DEC5C; identical to SEQ ID NO: 5775

SEQ ID NO: 12417 - protein, 266 aa, Escherichia coli DEC5C; identical to SEQ ID NO: 5772

SEQ ID NO: 12418 - protein, 161 aa, Escherichia coli DEC5C; identical to SEQ ID NO: 5769

SEQ ID NO: 12419 - protein, 351 aa, Escherichia coli DEC5C; identical to SEQ ID NO: 5768

SEQ ID NO: 12420 - protein, 366 aa, Escherichia coli DEC5C
MKLKIVAVVVTGLLAANVAHAAEVYNKDGNKLDLYGKVTALRYFTDDKRDDGDKTYARLGFKGETQINDQMIGFGHWEYDFKGYNDEANGSRDNKTRLAYAGLKISEFGSLDYGRNYGVGYDIGSWTDMLPEFGGDTWSQKDVFMTYRTTGVATYRNYDFFGLIEGLNFAAQYQGKNERTDNSHLYGADYTRANGDGFGISSTYVYDGFGIGAVYTKSDRTNAQERAAANPLNASGKNAELWATGIKYDANNIYFAANYAETLNMTTYGDGYISNKAQSFEVVAQYQFDFGLHPSLAYLKSKGIDLGRYGDQDMIEYIDVGATYFFNKNMSTYVDYKINLIDESDFTRAVDIRTDNIVATGITYQF

SEQ ID NO: 12421 - protein, 871 aa, Escherichia coli DEC5C
MHQVLLLPRFARLTIALSLATAVFPVDAEYYFNPRFLSNDLAESVDLSAFTKGREAPPGTYRVDIYLNDEFMTSRDITFITDDNNADLIPCLSTDLLVSLGIKKSALLDNKEHSAEKHVPDNSACTPLQDRLVDASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPRFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNLPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSTLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 12422 - protein, 236 aa, Escherichia coli DEC5C; identical to SEQ ID NO: 11364

SEQ ID NO: 12423 - protein, 746 aa, Escherichia coli DEC5C; identical to SEQ ID NO: 5761

SEQ ID NO: 12424 - protein, 193 aa, Escherichia coli DEC5C; identical to SEQ ID NO: 5760

SEQ ID NO: 12425 - protein, 243 aa, Escherichia coli DEC5C; identical to SEQ ID NO: 8524

SEQ ID NO: 12426 - protein, 816 aa, Escherichia coli DEC5C; identical to SEQ ID NO: 11682

SEQ ID NO: 12427 - protein, 430 aa, Escherichia coli DEC5C; identical to SEQ ID NO: 5759

SEQ ID NO: 12428 - protein, 331 aa, Escherichia coli DEC5C; identical to SEQ ID NO: 6551

SEQ ID NO: 12429 - protein, 760 aa, Escherichia coli DEC5C; identical to SEQ ID NO: 5756

SEQ ID NO: 12430 - protein, 203 aa, Escherichia coli DEC5C; identical to SEQ ID NO: 6414

SEQ ID NO: 12431 - protein, 361 aa, Escherichia coli DEC5C; identical to SEQ ID NO: 11373

SEQ ID NO: 12432 - protein, 224 aa, Escherichia coli DEC5C
MTVSLTAILLSCSSTWAAGKGGVELAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIGGKLVKNQMISPFDKYQFSLPKGAKNSSVTYRTINDYGAETPQLNCKS

SEQ ID NO: 12433 - protein, 630 aa, Escherichia coli DEC5C; identical to SEQ ID NO: 11764

SEQ ID NO: 12434 - protein, 226 aa, Escherichia coli DEC5C; identical to SEQ ID NO: 12281

SEQ ID NO: 12435 - protein, 209 aa, Escherichia coli DEC5C; identical to SEQ ID NO: 11379

SEQ ID NO: 12436 - protein, 840 aa, Escherichia coli DEC5C; identical to SEQ ID NO: 11380

SEQ ID NO: 12437 - protein, 233 aa, Escherichia coli DEC5C; identical to SEQ ID NO: 11381

SEQ ID NO: 12438 - protein, 191 aa, Escherichia coli DEC5C; identical to SEQ ID NO: 5748

SEQ ID NO: 12439 - protein, 232 aa, Escherichia coli DEC5C; identical to SEQ ID NO: 5747

SEQ ID NO: 12440 - protein, 729 aa, Escherichia coli DEC5C; identical to SEQ ID NO: 5745

SEQ ID NO: 12441 - protein, 213 aa, Escherichia coli DEC5C; identical to SEQ ID NO: 5744

SEQ ID NO: 12442 - protein, 203 aa, Escherichia coli DEC5C; identical to SEQ ID NO: 6347

SEQ ID NO: 12443 - protein, 656 aa, Escherichia coli DEC5C
MRLKKHYLCTALSLAFTQQAVAAQESDSLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSELGYLQVSGSQLKQDFLGLPHGVNNDIAGKHGKMINSSADDKRGIVKLGFTPRENDEYTLTYIKQDGEKDNPPYSGNCGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFVNEDTLALSYYDRKRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFIEEGRNFWAGVEYTF

SEQ ID NO: 12444 - protein, 207 aa, Escherichia coli DEC5C; identical to SEQ ID NO: 5743

SEQ ID NO: 12445 - protein, 407 aa, Escherichia coli DEC5C; identical to SEQ ID NO: 12294

SEQ ID NO: 12446 - protein, 539 aa, Escherichia coli DEC5C; identical to SEQ ID NO: 6525

SEQ ID NO: 12447 - protein, 700 aa, Escherichia coli DEC5C; identical to SEQ ID NO: 5740

SEQ ID NO: 12448 - protein, 111 aa, Escherichia coli DEC5C; identical to SEQ ID NO: 5738

SEQ ID NO: 12449 - protein, 118 aa, Escherichia coli DEC5C [sequence omitted]

SEQ ID NO: 12450 - protein, 395 aa, Escherichia coli DEC5C
MKRKVLAMLAPALLVAGAANAAEIYNKDGNKLDLYGKVAGLHYFSDDASSDGDMSYARIGFKGETQIADQFTGYGQWEFNIGANGPESDKGNTATRLAFAGFGFGQNGTFDYGRNYGVVYDVEAWTDMLPEFGGDTYAGADNFMNGRANSVATYRNNGFFGQVDGLNFALQYQGNNEKSGLFDQEGSGNGNGRKLAKENGDGYGMSTSYDFDFGLSLGAAYSNSDRTDNQVHKGTHNTRYGDRFDATAGGETAEAWTVGAKYDANNVYLAAMYAETRNMTGYGDADAIANKTQNFEVVAQYQFDFGLRPSIAYLQSKGKDLGGVNSDNFDSQGNHHYTNKDLVKYVDIGMTYYFNKNMSTYVDYKINLLDNDDDFYKENGIATDDIVAVGLVYQF

SEQ ID NO: 12451 - protein, 715 aa, Escherichia coli DEC5C
MLYNIPCRIYILSTLSLCISGIVSTATATSSETKISNEETLVVTTNRSASNLWETPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 12452 - protein, 143 aa, Escherichia coli DEC5C
MKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFTGRRVLLR

SEQ ID NO: 12453 - protein, 627 aa, Escherichia coli DEC5C; identical to SEQ ID NO: 11401

SEQ ID NO: 12454 - protein, 162 aa, Escherichia coli DEC5C; identical to SEQ ID NO: 5734

SEQ ID NO: 12455 - protein, 367 aa, Escherichia coli DEC5C; identical to SEQ ID NO: 5700

SEQ ID NO: 12456 - protein, 200 aa, Escherichia coli DEC5C; identical to SEQ ID NO: 5732

SEQ ID NO: 12457 - protein, 274 aa, Escherichia coli DEC5C; identical to SEQ ID NO: 5730

SEQ ID NO: 12458 - protein, 252 aa, Escherichia coli DEC5C; identical to SEQ ID NO: 12309

SEQ ID NO: 12459 - protein, 860 aa, Escherichia coli DEC5C; identical to SEQ ID NO: 12310

SEQ ID NO: 12460 - protein, 518 aa, Escherichia coli DEC5C; identical to SEQ ID NO: 6358

SEQ ID NO: 12461 - protein, 869 aa, Escherichia coli DEC5C
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGVPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSSNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 12462 - protein, 229 aa, Escherichia coli DEC5C
MTKIKLLMLIIFYLIISASVHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSLMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 12463 - protein, 432 aa, Escherichia coli DEC5C; identical to SEQ ID NO: 5727

SEQ ID NO: 12464 - protein, 567 aa, Escherichia coli DEC5C
MKIKLRITIILISVLCIFNGLLTPGAYAAAENGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGDGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 12465 - protein, 359 aa, Escherichia coli DEC5C
MKKYLALALIAPLLISCSTTKKGGTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPTSNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 12466 - protein, 686 aa, Escherichia coli DEC5C; identical to SEQ ID NO: 6339

SEQ ID NO: 12467 - protein, 224 aa, Escherichia coli DEC5C; identical to SEQ ID NO: 11649

SEQ ID NO: 12468 - protein, 838 aa, Escherichia coli DEC5C; identical to SEQ ID NO: 5723

SEQ ID NO: 12469 - protein, 678 aa, Escherichia coli DEC5C; identical to SEQ ID NO: 5722

SEQ ID NO: 12470 - protein, 689 aa, Escherichia coli DEC5C; identical to SEQ ID NO: 11798

SEQ ID NO: 12471 - protein, 660 aa, Escherichia coli DEC5C
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADCSTHISSSYSKQPGYGVNDFYVSYQGQQALKGMTTTLVLGNAFDKEYWSPQGIPQDGRNGKIFVSYQW

SEQ ID NO: 12472 - protein, 386 aa, Escherichia coli DEC5C; identical to SEQ ID NO: 11415

SEQ ID NO: 12473 - protein, 857 aa, Escherichia coli DEC5C
MSRKTVSRTFSSFSISVVAVAVASTFSAHAGKFNPKFLEDVQGVGQHVDLTMFEKGQEQQLPGIYRVSVYVNEQRMETRTLEFKEATEAQRKAMGESLVPCLSRTQLAEMGVRVESFPALNLVSAEACVPFDEIIPLASSHFDFSEQKLVLSFPQAAMHQVARGTVPESLWDEGIPALLLDYSFSGSNSEYDSTGSSSSYVDDNGTVHHDDGKDTLKSDSYYLNLRSGLNLGAWRLRNYSTWSHSGGKAQWDNIGTSLSRAIIPFKAQLTMGDTATAGDIFDSVQMRGAMLASDEEMLPDSQRGFAPIVRGIAKSNAEVSIEQNGYVIYRTYVQPGAFEINDLYPTANSGDLTVIIKEADGSEQRFIQPFSSVPIFQREGHLKYSFAAGEYQAGNYDSASPRFGQLDLIYGLPWGMTAYGGVLISNNYNAFALGIGKNFGYIGAISIDVTQAKSELNNDRDSQGQSYRFLYSKSFESGTDFRLAGYRYFTSGFYTFQEATDVRSDADSDYNRYHKRSEIQGNLTQQLGAYGSVYLNLTQQDYWNDAGKQNTVSAGYNGRIGKVSYSIAYSWNKSPEWDESDRLWSFNISVPLGRAWSNYRVTTDQDGRTNQQVGVSGTLLEDRNLSYSVQEGYASNGVGNSGNANVGYQGGSGNVNVGYSYGKDYRQLNYSVRGGVIVHSEGVTLSQPLGETMTLISVPGARNARVVNNGGVQVDWMGNAIVPYAMPYRENEISLRSDSLGDDVDVENAFQKVVPTRGAIVRARFDTRVGYRVLMTLLRSAGSPVPFGATATLITDKQNEVSSIVGEEGQLYISGMPEEGRVLIKWGNDASQQCVAPYKLSLELKQGGIIPVSANCQ

SEQ ID NO: 12474 - protein, 229 aa, Escherichia coli DEC5C
MMKSKFVALALSLFLSQSVLAGGVGLSSTRVIYDCSKKEASLTVQNKSKTEEFLIQSWVDDAAGSKKTPFIITPPLFKLDPEKNNILRIVNITPGLPQDRESVYWVNVKAIPSKSDDSENKNVLQIAVRTRIKLFYRPAGLKGDVKTAPNELRFTRNGNQLRVDNPTVFNITFNQFFANDKEIEKAGMVPAKGALNITLPAGVGSVSKIKYNTINDFGSSAEMITKNVD

SEQ ID NO: 12475 - protein, 512 aa, Escherichia coli DEC5C; identical to SEQ ID NO: 5948

SEQ ID NO: 12476 - protein, 108 aa, Escherichia coli DEC5C; identical to SEQ ID NO: 11583

SEQ ID NO: 12477 - protein, 208 aa, Escherichia coli DEC5C; identical to SEQ ID NO: 5717

SEQ ID NO: 12478 - protein, 614 aa, Escherichia coli DEC5C; identical to SEQ ID NO: 5716

SEQ ID NO: 12479 - protein, 368 aa, Escherichia coli DEC5C; identical to SEQ ID NO: 11425

SEQ ID NO: 12480 - protein, 241 aa, Escherichia coli DEC5C; identical to SEQ ID NO: 5710

SEQ ID NO: 12481 - protein, 863 aa, Escherichia coli DEC5C
MHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPLAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 12482 - protein, 446 aa, Escherichia coli DEC5C; identical to SEQ ID NO: 5714

SEQ ID NO: 12483 - protein, 237 aa, Escherichia coli DEC5C; identical to SEQ ID NO: 5713

SEQ ID NO: 12484 - protein, 478 aa, Escherichia coli DEC5C; identical to SEQ ID NO: 5711

SEQ ID NO: 12485 - protein, 368 aa, Escherichia coli DEC5D; identical to SEQ ID NO: 11425

SEQ ID NO: 12486 - protein, 216 aa, Escherichia coli DEC5D
MAMMVAGRAEAGVALGATRIIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTLYYLTVTELNAGARVLENALVPPMGESTVKLPSDAGSNITYRTINDYGALTPKMTGVME

SEQ ID NO: 12487 - protein, 863 aa, Escherichia coli DEC5D; identical to SEQ ID NO: 12481

SEQ ID NO: 12488 - protein, 816 aa, Escherichia coli DEC5D; identical to SEQ ID NO: 11428

SEQ ID NO: 12489 - protein, 227 aa, Escherichia coli DEC5D; identical to SEQ ID NO: 11429

SEQ ID NO: 12490 - protein, 170 aa, Escherichia coli DEC5D; identical to SEQ ID NO: 5855

SEQ ID NO: 12491 - protein, 238 aa, Escherichia coli DEC5D
MVKKTVSALFVSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRLSGLQGEPAEAPAKITWKLNNAQLQANNPTPYYVSFNEVKLESGGKTYNVNSSMVTPFSQASFGVTGLPGSVSSGKVVFKAINDFGGNIDGSATF

SEQ ID NO: 12492 - protein, 747 aa, Escherichia coli DEC5D; identical to SEQ ID NO: 5775

SEQ ID NO: 12493 - protein, 266 aa, Escherichia coli DEC5D; identical to SEQ ID NO: 5772

SEQ ID NO: 12494 - protein, 161 aa, Escherichia coli DEC5D; identical to SEQ ID NO: 5769

SEQ ID NO: 12495 - protein, 351 aa, Escherichia coli DEC5D; identical to SEQ ID NO: 5768

SEQ ID NO: 12496 - protein, 229 aa, Escherichia coli DEC5D; identical to SEQ ID NO: 12462

SEQ ID NO: 12497 - protein, 869 aa, Escherichia coli DEC5D; identical to SEQ ID NO: 12461

SEQ ID NO: 12498 - protein, 746 aa, Escherichia coli DEC5D; identical to SEQ ID NO: 5761

SEQ ID NO: 12499 - protein, 193 aa, Escherichia coli DEC5D; identical to SEQ ID NO: 5760

SEQ ID NO: 12500 - protein, 243 aa, Escherichia coli DEC5D; identical to SEQ ID NO: 8524

SEQ ID NO: 12501 - protein, 816 aa, Escherichia coli DEC5D; identical to SEQ ID NO: 11682

SEQ ID NO: 12502 - protein, 430 aa, Escherichia coli DEC5D; identical to SEQ ID NO: 5759

SEQ ID NO: 12503 - protein, 331 aa, Escherichia coli DEC5D; identical to SEQ ID NO: 6551

SEQ ID NO: 12504 - protein, 760 aa, Escherichia coli DEC5D; identical to SEQ ID NO: 5756

SEQ ID NO: 12505 - protein, 203 aa, Escherichia coli DEC5D; identical to SEQ ID NO: 6414

SEQ ID NO: 12506 - protein, 361 aa, Escherichia coli DEC5D; identical to SEQ ID NO: 11373

SEQ ID NO: 12507 - protein, 224 aa, Escherichia coli DEC5D; identical to SEQ ID NO: 12432

SEQ ID NO: 12508 - protein, 630 aa, Escherichia coli DEC5D; identical to SEQ ID NO: 11764

SEQ ID NO: 12509 - protein, 226 aa, Escherichia coli DEC5D; identical to SEQ ID NO: 12281

SEQ ID NO: 12510 - protein, 229 aa, Escherichia coli DEC5D; identical to SEQ ID NO: 8514

SEQ ID NO: 12511 - protein, 835 aa, Escherichia coli DEC5D; identical to SEQ ID NO: 11456

SEQ ID NO: 12512 - protein, 233 aa, Escherichia coli DEC5D; identical to SEQ ID NO: 11381

SEQ ID NO: 12513 - protein, 517 aa, Escherichia coli DEC5D; identical to SEQ ID NO: 6817

SEQ ID NO: 12514 - protein, 191 aa, Escherichia coli DEC5D; identical to SEQ ID NO: 5748

SEQ ID NO: 12515 - protein, 232 aa, Escherichia coli DEC5D; identical to SEQ ID NO: 5747

SEQ ID NO: 12516 - protein, 729 aa, Escherichia coli DEC5D; identical to SEQ ID NO: 5745

SEQ ID NO: 12517 - protein, 213 aa, Escherichia coli DEC5D; identical to SEQ ID NO: 5744

SEQ ID NO: 12518 - protein, 656 aa, Escherichia coli DEC5D; identical to SEQ ID NO: 12443

SEQ ID NO: 12519 - protein, 207 aa, Escherichia coli DEC5D; identical to SEQ ID NO: 5743

SEQ ID NO: 12520 - protein, 166 aa, Escherichia coli DEC5D
MVGPPGPKGEQGPAGPQGPKGDKGERGDTGPVGATGERGPAGDAGPAGPQGPKGDRGERGETGLTGNAGPQGPKGDTGAAGPAGPQGPKGETGAAGPVGATGPQGPKGDPGETQIRFRLGPASIIETNSNGWFPGTDGALITGLTFLPPKMPHGFRVFSAFAGQVW

SEQ ID NO: 12521 - protein, 551 aa, Escherichia coli DEC5D; identical to SEQ ID NO: 5742

SEQ ID NO: 12522 - protein, 700 aa, Escherichia coli DEC5D; identical to SEQ ID NO: 5740

SEQ ID NO: 12523 - protein, 366 aa, Escherichia coli DEC5D; identical to SEQ ID NO: 12420

SEQ ID NO: 12524 - protein, 236 aa, Escherichia coli DEC5D; identical to SEQ ID NO: 11364

SEQ ID NO: 12525 - protein, 118 aa, Escherichia coli DEC5D [sequence omitted]

SEQ ID NO: 12526 - protein, 395 aa, Escherichia coli DEC5D; identical to SEQ ID NO: 12450

SEQ ID NO: 12527 - protein, 111 aa, Escherichia coli DEC5D; identical to SEQ ID NO: 5738

SEQ ID NO: 12528 - protein, 715 aa, Escherichia coli DEC5D; identical to SEQ ID NO: 12451

SEQ ID NO: 12529 - protein, 143 aa, Escherichia coli DEC5D; identical to SEQ ID NO: 12452

SEQ ID NO: 12530 - protein, 627 aa, Escherichia coli DEC5D; identical to SEQ ID NO: 11401

SEQ ID NO: 12531 - protein, 162 aa, Escherichia coli DEC5D; identical to SEQ ID NO: 5734

SEQ ID NO: 12532 - protein, 367 aa, Escherichia coli DEC5D; identical to SEQ ID NO: 5700

SEQ ID NO: 12533 - protein, 200 aa, Escherichia coli DEC5D; identical to SEQ ID NO: 5732

SEQ ID NO: 12534 - protein, 274 aa, Escherichia coli DEC5D; identical to SEQ ID NO: 5730

SEQ ID NO: 12535 - protein, 252 aa, Escherichia coli DEC5D; identical to SEQ ID NO: 12309

SEQ ID NO: 12536 - protein, 860 aa, Escherichia coli DEC5D; identical to SEQ ID NO: 12310

SEQ ID NO: 12537 - protein, 518 aa, Escherichia coli DEC5D; identical to SEQ ID NO: 6358

SEQ ID NO: 12538 - protein, 432 aa, Escherichia coli DEC5D; identical to SEQ ID NO: 5727

SEQ ID NO: 12539 - protein, 567 aa, Escherichia coli DEC5D; identical to SEQ ID NO: 12464

SEQ ID NO: 12540 - protein, 359 aa, Escherichia coli DEC5D; identical to SEQ ID NO: 12465

SEQ ID NO: 12541 - protein, 615 aa, Escherichia coli DEC5D
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKNVT

SEQ ID NO: 12542 - protein, 713 aa, Escherichia coli DEC5D; identical to SEQ ID NO: 11726

SEQ ID NO: 12543 - protein, 231 aa, Escherichia coli DEC5D; identical to SEQ ID NO: 5724

SEQ ID NO: 12544 - protein, 838 aa, Escherichia coli DEC5D; identical to SEQ ID NO: 5723

SEQ ID NO: 12545 - protein, 678 aa, Escherichia coli DEC5D; identical to SEQ ID NO: 5722

SEQ ID NO: 12546 - protein, 386 aa, Escherichia coli DEC5D; identical to SEQ ID NO: 11415

SEQ ID NO: 12547 - protein, 660 aa, Escherichia coli DEC5D; identical to SEQ ID NO: 12471

SEQ ID NO: 12548 - protein, 857 aa, Escherichia coli DEC5D; identical to SEQ ID NO: 12473

SEQ ID NO: 12549 - protein, 229 aa, Escherichia coli DEC5D; identical to SEQ ID NO: 12474

SEQ ID NO: 12550 - protein, 514 aa, Escherichia coli DEC5D; identical to SEQ ID NO: 11496

SEQ ID NO: 12551 - protein, 108 aa, Escherichia coli DEC5D; identical to SEQ ID NO: 11583

SEQ ID NO: 12552 - protein, 614 aa, Escherichia coli DEC5D; identical to SEQ ID NO: 5716

SEQ ID NO: 12553 - protein, 208 aa, Escherichia coli DEC5D; identical to SEQ ID NO: 5717

SEQ ID NO: 12554 - protein, 237 aa, Escherichia coli DEC5D; identical to SEQ ID NO: 5713

SEQ ID NO: 12555 - protein, 478 aa, Escherichia coli DEC5D; identical to SEQ ID NO: 5711

SEQ ID NO: 12556 - protein, 445 aa, Escherichia coli DEC5D
MITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEVNPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNGDSKVNPNYGKAVPADFNGGSFGRGDSDEWTFGAQMEIWW

SEQ ID NO: 12557 - protein, 94 aa, Escherichia coli DEC5D; identical to SEQ ID NO: 12316

SEQ ID NO: 12558 - protein, 351 aa, Escherichia coli DEC5E; identical to SEQ ID NO: 5767

SEQ ID NO: 12559 - protein, 159 aa, Escherichia coli DEC5E
MMTKIKLLMLIIFYLIISASVHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSLMKLFLRPIQLQELPAEAPDTLKFS

SEQ ID NO: 12560 - protein, 869 aa, Escherichia coli DEC5E; identical to SEQ ID NO: 12461

SEQ ID NO: 12561 - protein, 243 aa, Escherichia coli DEC5E; identical to SEQ ID NO: 8524

SEQ ID NO: 12562 - protein, 816 aa, Escherichia coli DEC5E; identical to SEQ ID NO: 12337

SEQ ID NO: 12563 - protein, 430 aa, Escherichia coli DEC5E; identical to SEQ ID NO: 5758

SEQ ID NO: 12564 - protein, 746 aa, Escherichia coli DEC5E; identical to SEQ ID NO: 5761

SEQ ID NO: 12565 - protein, 193 aa, Escherichia coli DEC5E; identical to SEQ ID NO: 5760

SEQ ID NO: 12566 - protein, 331 aa, Escherichia coli DEC5E; identical to SEQ ID NO: 6551

SEQ ID NO: 12567 - protein, 760 aa, Escherichia coli DEC5E
MENNRNFPARQFHSLTFFAGLCIGITPVAQALAAEGQTNADDTLVVEASTPSLYALQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTATLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTASIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDEGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 12568 - protein, 203 aa, Escherichia coli DEC5E; identical to SEQ ID NO: 6414

SEQ ID NO: 12569 - protein, 361 aa, Escherichia coli DEC5E; identical to SEQ ID NO: 11373

SEQ ID NO: 12570 - protein, 224 aa, Escherichia coli DEC5E
MTVSLTAILLSCSSTWAAGKGGVGLAATRLVYSEGEEQISLGVRNTSPDVPYLIQSWVMTPDNKKSADFIITPPLFVLNPANENLLRIMYIGAPLAKDRETIFFTSVRAVPSTTKREEGNTLKIATQSVIKLFWRPKGLAYPLGEAPAKLRCTSSADMVTVSNPTPYFITLTDLKIGGKLVKNQMISPFDKYQFSLPKGAKNSSVTYRTINDYGAETPQLNCKS

SEQ ID NO: 12571 - protein, 370 aa, Escherichia coli DEC5E
MQRAVIPLKGELTVGDDYTAGDFFDSVSFRGVQLASDDNMLPDSLKGFAPVVRGIAKSNAQITIKQNGYTIYQTYVSPGAFEISDIYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLSEYGSFYLSGSQQTYWHTDQQDRLLQFGYNTQIKALSLGISWNYSKSRGQPDADQVFALNFSLPLNLLLSRSNDSYTSKKITPG

SEQ ID NO: 12572 - protein, 226 aa, Escherichia coli DEC5E; identical to SEQ ID NO: 12281

SEQ ID NO: 12573 - protein, 784 aa, Escherichia coli DEC5E
MNKSVVSISAAMLVLLCQPVMGSEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAKELAPGITSQTQLSQLRLDLSVPQSQLISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTIVGLNASKGQDYWQASGNVQGAMAVHGGGITFGPYLGETFALVEAKGAEGAKVYNSSQLEINDSGYALVPAVTPYRYNRISLDPQGMDGDAELVDSERQVAPVAGAAVKVIFRTRPGKALLIKSRMADGSELPMGADVLDENRSLT

SEQ ID NO: 12574 - protein, 233 aa, Escherichia coli DEC5E; identical to SEQ ID NO: 11381

SEQ ID NO: 12575 - protein, 669 aa, Escherichia coli DEC5E; identical to SEQ ID NO: 8890

SEQ ID NO: 12576 - protein, 732 aa, Escherichia coli DEC5E
MMRKKYMPRALGPLLLVVLSPAVAQQNDDNEIIVSASRSNRTVAEMAQTIWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLRQELVGQVYYRDESLRFYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYISWAPEPWSLRVQSTTSFDVSDAEGNDINGYTTVDFISSWLLPVGTLSFSVENLFDRDYTTVWGQRAPLYYSPGYGPASLYDYKGRGRTFGLNYSVLF

SEQ ID NO: 12577 - protein, 191 aa, Escherichia coli DEC5E; identical to SEQ ID NO: 5748

SEQ ID NO: 12578 - protein, 232 aa, Escherichia coli DEC5E; identical to SEQ ID NO: 5747

SEQ ID NO: 12579 - protein, 729 aa, Escherichia coli DEC5E; identical to SEQ ID NO: 5745

SEQ ID NO: 12580 - protein, 213 aa, Escherichia coli DEC5E; identical to SEQ ID NO: 5744

SEQ ID NO: 12581 - protein, 203 aa, Escherichia coli DEC5E; identical to SEQ ID NO: 6347

SEQ ID NO: 12582 - protein, 656 aa, Escherichia coli DEC5E
MRLKKHYLCTALSLAFTQQAVAAQESDSLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMDGAINITTQKPTKPLEASLGYRQGWSRSQDNAYDMHASFAASSELGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFVNEDTLALSYYDRKRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFIEEGRNFWAGVEYTF

SEQ ID NO: 12583 - protein, 87 aa, Escherichia coli DEC5E
MIPAAVLMMFFPQLAMVAGSSGQDLMASGNTTVKATFGKDSSVVKWVVLAEVLVGAVMYMMTKNVKFLAGFAIISVFIAVGMAVVGL

SEQ ID NO: 12584 - protein, 207 aa, Escherichia coli DEC5E; identical to SEQ ID NO: 5743

SEQ ID NO: 12585 - protein, 111 aa, Escherichia coli DEC5E; identical to SEQ ID NO: 5738

SEQ ID NO: 12586 - protein, 539 aa, Escherichia coli DEC5E; identical to SEQ ID NO: 6525

SEQ ID NO: 12587 - protein, 700 aa, Escherichia coli DEC5E
MKIVFVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSSRDDMSVMMYAGERETTQYQSIPMAPQLNPSHAGSVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRCFETPTINELSYRADGQSGMNFGLKPSTNDTIDIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGMEARYMGDIMADDENTAKAPSYTLVGLFTGYKYNYHNLTVDLFGRVDNLFDKEYVGSVIVNESNGRYYEPAPGRNYGVGVNIAWRFE

SEQ ID NO: 12588 - protein, 366 aa, Escherichia coli DEC5E; identical to SEQ ID NO: 12420

SEQ ID NO: 12589 - protein, 871 aa, Escherichia coli DEC5E; identical to SEQ ID NO: 12298

SEQ ID NO: 12590 - protein, 121 aa, Escherichia coli DEC5E
MNITIIPAMEKDQKNENTLQLAIISRIKMFYRPTNLAMAPEEAPAMLRFRRSGSNLTLINPTPYFITVTNMKAGNSNLPNTMVPPKGEVSVDIPHAATGDISFQTINDYGALTPRIKATMQ

SEQ ID NO: 12591 - protein, 130 aa, Escherichia coli DEC5E; identical to SEQ ID NO: 7726

SEQ ID NO: 12592 - protein, 395 aa, Escherichia coli DEC5E; identical to SEQ ID NO: 12302

SEQ ID NO: 12593 - protein, 673 aa, Escherichia coli DEC5E
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSLELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLSWQATERMNISVYVDNLFDRRYRTYGYMNGSSAVAQVNMGRTVGINTRIDFF

SEQ ID NO: 12594 - protein, 715 aa, Escherichia coli DEC5E; identical to SEQ ID NO: 11710

SEQ ID NO: 12595 - protein, 224 aa, Escherichia coli DEC5E; identical to SEQ ID NO: 6435

SEQ ID NO: 12596 - protein, 637 aa, Escherichia coli DEC5E; identical to SEQ ID NO: 11485

SEQ ID NO: 12597 - protein, 162 aa, Escherichia coli DEC5E
MKTILPAVLFAAFATISAWAAESVQPLEKIAPYPQAEKGMKRQVIQLTPQEDESTLKVELLIGQTLEVDCNLHRLGGKLESKTLEGWGYDYYVFDKVSSPVSTMMACPDGKKEKKFVTAYLGDTGMLRYNSKLPIVVYTPDNVDVKYRVWKAEEKIDNAVVR

SEQ ID NO: 12598 - protein, 367 aa, Escherichia coli DEC5E; identical to SEQ ID NO: 5700

SEQ ID NO: 12599 - protein, 200 aa, Escherichia coli DEC5E; identical to SEQ ID NO: 5732

SEQ ID NO: 12600 - protein, 274 aa, Escherichia coli DEC5E; identical to SEQ ID NO: 5730

SEQ ID NO: 12601 - protein, 252 aa, Escherichia coli DEC5E; identical to SEQ ID NO: 12309

SEQ ID NO: 12602 - protein, 860 aa, Escherichia coli DEC5E
MSGSYVNAWAENEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISDVAHTTAKVTVSQLGRVIYETQVPAGPFRIQDLGDSVSGTLHIRIEEQNGQVQEYDINTASMPFLTRPGQVRYKLMMGRPQEWGHHVEGGFFSSGEASWGIANGWSLYGGALADEHYQSAALGVGRDLSVFGAVAFDITHSHTRLDKETAYGKGSLDGNSFRLSYSKDFDELNSRVTFAGYRFSEENFMTMSEYLDASDSEMVRTGNDKEMYTATYNQNFRDAGVSVYLNYTGHTYWDRDEQTNYNVMLSHYFNLGSIRNMSISMTGYRYEYDNQADKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQATLTEGAIGYHKFSVISGQKAMAVLRLQDGSYPPFGAEVKNDSAQNVGLVDDDGNVYLAGVKPGEHMIVSWGGVAHCDIHLPDPLPADLFNGLLLPCQQTGAISPSIPHEIKPVIQEQTQQVMPTEAPVSVSAN

SEQ ID NO: 12603 - protein, 518 aa, Escherichia coli DEC5E
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPKLAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 12604 - protein, 567 aa, Escherichia coli DEC5E; identical to SEQ ID NO: 11409

SEQ ID NO: 12605 - protein, 359 aa, Escherichia coli DEC5E; identical to SEQ ID NO: 11410

SEQ ID NO: 12606 - protein, 860 aa, Escherichia coli DEC5E; identical to SEQ ID NO: 5691

SEQ ID NO: 12607 - protein, 217 aa, Escherichia coli DEC5E
MRVVAVFTGMLTGVLSVTGLLSAGAYAAGGEGNMSASATETNARVFSLHLGATRVVYNPASSGETLTVINDQDYPMLVQSEVLSEDQKSPAPFVVTPPLFRLDGQQSSRLRIVRTGGEFPSDRESLQWICVKGIPPKEDDRWAEGKDGEKKADKVSLNVQLSVSSCIKLFVRPPAVKGRPDDVAGKVEWQRAGNRLKGVNPTPFYINLSTLTVGVRK

SEQ ID NO: 12608 - protein, 689 aa, Escherichia coli DEC5E; identical to SEQ ID NO: 11798

SEQ ID NO: 12609 - protein, 199 aa, Escherichia coli DEC5E
MIYDASRKEAALPVANKGTETPYLLQSWVDNIDGTSRAPFIITPPLIRLEAGDDSSLRIIKTADNLPENKESLFYINVRAIPAKKKSDDVNANELTLVFKTRIKMFYRPAHLKGRVSDAWKSLEFKRSDHSLNIYNPTEYYVVFAGLAVDKADLTSKIEYIAPGEHKQLPLPASGGKNVKWAAINDYGGSSGTETRPLQ

SEQ ID NO: 12610 - protein, 838 aa, Escherichia coli DEC5E; identical to SEQ ID NO: 5723

SEQ ID NO: 12611 - protein, 678 aa, Escherichia coli DEC5E; identical to SEQ ID NO: 5722

SEQ ID NO: 12612 - protein, 432 aa, Escherichia coli DEC5E; identical to SEQ ID NO: 5727

SEQ ID NO: 12613 - protein, 514 aa, Escherichia coli DEC5E; identical to SEQ ID NO: 11496

SEQ ID NO: 12614 - protein, 386 aa, Escherichia coli DEC5E; identical to SEQ ID NO: 11415

SEQ ID NO: 12615 - protein, 108 aa, Escherichia coli DEC5E; identical to SEQ ID NO: 11583

SEQ ID NO: 12616 - protein, 660 aa, Escherichia coli DEC5E; identical to SEQ ID NO: 11731

SEQ ID NO: 12617 - protein, 857 aa, Escherichia coli DEC5E; identical to SEQ ID NO: 12401

SEQ ID NO: 12618 - protein, 229 aa, Escherichia coli DEC5E; identical to SEQ ID NO: 11418

SEQ ID NO: 12619 - protein, 208 aa, Escherichia coli DEC5E; identical to SEQ ID NO: 5717

SEQ ID NO: 12620 - protein, 614 aa, Escherichia coli DEC5E; identical to SEQ ID NO: 5716

SEQ ID NO: 12621 - protein, 241 aa, Escherichia coli DEC5E; identical to SEQ ID NO: 12415

SEQ ID NO: 12622 - protein, 747 aa, Escherichia coli DEC5E; identical to SEQ ID NO: 5775

SEQ ID NO: 12623 - protein, 266 aa, Escherichia coli DEC5E; identical to SEQ ID NO: 5772

SEQ ID NO: 12624 - protein, 161 aa, Escherichia coli DEC5E; identical to SEQ ID NO: 5769

SEQ ID NO: 12625 - protein, 774 aa, Escherichia coli DEC5E; identical to SEQ ID NO: 6325

SEQ ID NO: 12626 - protein, 368 aa, Escherichia coli DEC5E
MNKTITALAIMMASFAANASVLPETPVPFKSGTGAIDNDTVYIGLGSAGTAWYKLDTQAKDKKWTALAAFPGGPRDQATSAFIDGDLYLFGGIGKNSKGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGDNLKWNRLAPVSSPDGVAGGFAGISNDSLIFAGGAGFKGSRENYQNGKNYAHEGLKKSYSTDIHLWHNGKWDKSGELSQGRAYGVSLPWNNSLLIIGGESAGGKAVTDSVLISVKDNKVTVQN

SEQ ID NO: 12627 - protein, 241 aa, Escherichia coli DEC5E; identical to SEQ ID NO: 6143

SEQ ID NO: 12628 - protein, 856 aa, Escherichia coli DEC5E
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNMASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLVGVYGTLLEDNNLSYSVQTGYAGGGDGNSGSTGYATLNYRGGYGNANIGYSHSDDIKQLYYGVSGGILAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 12629 - protein, 446 aa, Escherichia coli DEC5E; identical to SEQ ID NO: 5714

SEQ ID NO: 12630 - protein, 237 aa, Escherichia coli DEC5E; identical to SEQ ID NO: 5713

SEQ ID NO: 12631 - protein, 816 aa, Escherichia coli DEC5E; identical to SEQ ID NO: 11428

SEQ ID NO: 12632 - protein, 227 aa, Escherichia coli DEC5E; identical to SEQ ID NO: 11429

SEQ ID NO: 12633 - protein, 478 aa, Escherichia coli DEC5E; identical to SEQ ID NO: 5711

SEQ ID NO: 12634 - protein, 170 aa, Escherichia coli DEC5E; identical to SEQ ID NO: 5855

SEQ ID NO: 12635 - protein, 407 aa, Escherichia coli DEC5E
MTERELSIIRALGEEFSTVLADLQRTFEGKMASQAQAFEEKLTSLSAVLQKHVTVDEVRPVLLAMVDDAVGTIPVPRDGRDYDPDVLQQAVNDAVANIPVPADGKSITPDDVRPMLEQMVKEAVSHIPVPRDGRDYDPEVLKQAVNDAVANIPVPADGKSITPDDVRPMLEQMVKEAVSHIPVPRDGRDYDPEVLQKAVNDAVANIPVPADGKSITPDDVRPMLEQMVKEAVSHIPVPRDGRDYDPDVLQKAVLDAVRALPAPQDGRDATALEIIPAIDDQKSFPRGTYATHLGGFWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRDAGGGK

SEQ ID NO: 12636 - protein, 62 aa, Escherichia coli DEC5E
MASGNTTVKATFGKDSSVVKWVVLAEVLVGAVMYMMTKNVKFLAGFAIISVFIAVGMAVVGL

SEQ ID NO: 12637 - protein, 651 aa, Escherichia coli DEC5E; identical to SEQ ID NO: 12315

SEQ ID NO: 12638 - protein, 120 aa, Escherichia coli DEC5E; identical to SEQ ID NO: 5799

SEQ ID NO: 12639 - protein, 784 aa, Escherichia coli DEC6A; identical to SEQ ID NO: 6283

SEQ ID NO: 12640 - protein, 170 aa, Escherichia coli DEC6A [sequence omitted]

SEQ ID NO: 12641 - protein, 865 aa, Escherichia coli DEC6A; identical to SEQ ID NO: 6375

SEQ ID NO: 12642 - protein, 246 aa, Escherichia coli DEC6A; identical to SEQ ID NO: 6964

SEQ ID NO: 12643 - protein, 747 aa, Escherichia coli DEC6A; identical to SEQ ID NO: 6343

SEQ ID NO: 12644 - protein, 266 aa, Escherichia coli DEC6A; identical to SEQ ID NO: 5772

SEQ ID NO: 12645 - protein, 161 aa, Escherichia coli DEC6A; identical to SEQ ID NO: 5769

SEQ ID NO: 12646 - protein, 221 aa, Escherichia coli DEC6A; identical to SEQ ID NO: 8014

SEQ ID NO: 12647 - protein, 351 aa, Escherichia coli DEC6A; identical to SEQ ID NO: 6367

SEQ ID NO: 12648 - protein, 230 aa, Escherichia coli DEC6A; identical to SEQ ID NO: 6360

SEQ ID NO: 12649 - protein, 869 aa, Escherichia coli DEC6A
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTVLGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 12650 - protein, 746 aa, Escherichia coli DEC6A
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLGATWDVTKNVSLTGGVDNLFDKRLWRAGNAQTTGDLAGANYIAGAGAYTYNEPGRTWYMSVNTHF

SEQ ID NO: 12651 - protein, 193 aa, Escherichia coli DEC6A; identical to SEQ ID NO: 6300

SEQ ID NO: 12652 - protein, 331 aa, Escherichia coli DEC6A
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKANLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 12653 - protein, 760 aa, Escherichia coli DEC6A; identical to SEQ ID NO: 6415

SEQ ID NO: 12654 - protein, 203 aa, Escherichia coli DEC6A; identical to SEQ ID NO: 6414

SEQ ID NO: 12655 - protein, 361 aa, Escherichia coli DEC6A; identical to SEQ ID NO: 7868

SEQ ID NO: 12656 - protein, 224 aa, Escherichia coli DEC6A; identical to SEQ ID NO: 7705

SEQ ID NO: 12657 - protein, 591 aa, Escherichia coli DEC6A; identical to SEQ ID NO: 7746

SEQ ID NO: 12658 - protein, 128 aa, Escherichia coli DEC6A
MDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAIAPCHVAWRAINDYGGLSAKKEQNLP

SEQ ID NO: 12659 - protein, 242 aa, Escherichia coli DEC6A; identical to SEQ ID NO: 6420

SEQ ID NO: 12660 - protein, 815 aa, Escherichia coli DEC6A; identical to SEQ ID NO: 6927

SEQ ID NO: 12661 - protein, 430 aa, Escherichia coli DEC6A; identical to SEQ ID NO: 5758

SEQ ID NO: 12662 - protein, 732 aa, Escherichia coli DEC6A; identical to SEQ ID NO: 8819

SEQ ID NO: 12663 - protein, 517 aa, Escherichia coli DEC6A; identical to SEQ ID NO: 6406

SEQ ID NO: 12664 - protein, 191 aa, Escherichia coli DEC6A; identical to SEQ ID NO: 5748

SEQ ID NO: 12665 - protein, 232 aa, Escherichia coli DEC6A; identical to SEQ ID NO: 5747

SEQ ID NO: 12666 - protein, 729 aa, Escherichia coli DEC6A; identical to SEQ ID NO: 6402

SEQ ID NO: 12667 - protein, 213 aa, Escherichia coli DEC6A; identical to SEQ ID NO: 5744

SEQ ID NO: 12668 - protein, 203 aa, Escherichia coli DEC6A; identical to SEQ ID NO: 6396

SEQ ID NO: 12669 - protein, 207 aa, Escherichia coli DEC6A; identical to SEQ ID NO: 5743

SEQ ID NO: 12670 - protein, 118 aa, Escherichia coli DEC6A [sequence omitted]

SEQ ID NO: 12671 - protein, 539 aa, Escherichia coli DEC6A; identical to SEQ ID NO: 6391

SEQ ID NO: 12672 - protein, 700 aa, Escherichia coli DEC6A; identical to SEQ ID NO: 6388

SEQ ID NO: 12673 - protein, 111 aa, Escherichia coli DEC6A; identical to SEQ ID NO: 8122

SEQ ID NO: 12674 - protein, 407 aa, Escherichia coli DEC6A; identical to SEQ ID NO: 10865

SEQ ID NO: 12675 - protein, 395 aa, Escherichia coli DEC6A; identical to SEQ ID NO: 10474

SEQ ID NO: 12676 - protein, 673 aa, Escherichia coli DEC6A
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSSPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 12677 - protein, 669 aa, Escherichia coli DEC6A; identical to SEQ ID NO: 8890

SEQ ID NO: 12678 - protein, 826 aa, Escherichia coli DEC6A
MLRMTPLASAIVALLFGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKHSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEIPPSVNVAIDKQKGLSCTITFGKEIDESRNYICQ

SEQ ID NO: 12679 - protein, 224 aa, Escherichia coli DEC6A; identical to SEQ ID NO: 6435

SEQ ID NO: 12680 - protein, 641 aa, Escherichia coli DEC6A; identical to SEQ ID NO: 7667

SEQ ID NO: 12681 - protein, 162 aa, Escherichia coli DEC6A; identical to SEQ ID NO: 6365

SEQ ID NO: 12682 - protein, 367 aa, Escherichia coli DEC6A
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGNPSGEDFTSGVTNNGRDALRQNGDGVGGSITYDYEGFGIGGAISSSKRTDAQNTAAYIGNGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 12683 - protein, 200 aa, Escherichia coli DEC6A; identical to SEQ ID NO: 6363

SEQ ID NO: 12684 - protein, 274 aa, Escherichia coli DEC6A; identical to SEQ ID NO: 6362

SEQ ID NO: 12685 - protein, 250 aa, Escherichia coli DEC6A; identical to SEQ ID NO: 6361

SEQ ID NO: 12686 - protein, 881 aa, Escherichia coli DEC6A
MPDHSLFRLRILPWCIALAMSGSYSSVWAEDDIQFDSRFLELKGDTKIDLKRFSSQGDVEPGKYNLQVQLNKQPLAEEYDIYWYAGEDDVSKSYACLTPELVAQFGLKEDVAKNLQWSHDGKCLKPGQLEGVEIKADLSQSALVISLPQAYLEYTWPDWDPPSRWDDGISGIIADYSITAQTRHEENGGDDSNEISGNGTVGVNLGPWRMRADWQTNYQHTRSNDDDDEFGGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGGFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNIGTSDKHTSVDGYYSHDGSLAQVDLSANYHEGQYTSAGLSLQGGATLTTHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGSVYLAGVKPGEHMSVFWSGVAHCDINLPDPLPADLFNGLLLPCQHKGNVAPVVPDDIKPVIQEQTQQVTPTDPPVSVSANQ

SEQ ID NO: 12687 - protein, 518 aa, Escherichia coli DEC6A; identical to SEQ ID NO: 6358

SEQ ID NO: 12688 - protein, 432 aa, Escherichia coli DEC6A; identical to SEQ ID NO: 5727

SEQ ID NO: 12689 - protein, 359 aa, Escherichia coli DEC6A; identical to SEQ ID NO: 5847

SEQ ID NO: 12690 - protein, 686 aa, Escherichia coli DEC6A; identical to SEQ ID NO: 6339

SEQ ID NO: 12691 - protein, 834 aa, Escherichia coli DEC6A; identical to SEQ ID NO: 7680

SEQ ID NO: 12692 - protein, 249 aa, Escherichia coli DEC6A; identical to SEQ ID NO: 6407

SEQ ID NO: 12693 - protein, 231 aa, Escherichia coli DEC6A; identical to SEQ ID NO: 6400

SEQ ID NO: 12694 - protein, 838 aa, Escherichia coli DEC6A; identical to SEQ ID NO: 6399

SEQ ID NO: 12695 - protein, 678 aa, Escherichia coli DEC6A
MVPSTFSRLKAARCLPVVLAALIFAGCGTHTPDQSTAYMQGTAQADSAFYLQQMQQSSDDTRINWQLLAIRALVKEGKTGQAVELFNQLPQELNDAQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKSIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRNLSWLQYQQGQVVPVS

SEQ ID NO: 12696 - protein, 738 aa, Escherichia coli DEC6A
MPGEYSLIVSVNGEKKGNIATRFDENGDICLDQAFLQQAGLKIPSEEKNGCYDYILSYPGTTITPLPNQEALDIIVSPQAIIPIGLDLTNAATGGTAALLNYSLMSSRAEFSNGSSDYSQAALEGGININDWMLRSHQFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRVDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFAIAKMDNNIAGVRITSQAGPVWTDFRGNAVIPSIQPWRTSGVEIDTASLPKNVDIGNGTKMIKQGRGAVGKVGFSAITQRRALLSITLSDGKKLPRGVAIEDSEGNYLTTSVDDGVVFLNNIKPDMVLDIKDEQQSCRIHLTFPEDAPKDVFYETATGECQ

SEQ ID NO: 12697 - protein, 654 aa, Escherichia coli DEC6A; identical to SEQ ID NO: 6425

SEQ ID NO: 12698 - protein, 897 aa, Escherichia coli DEC6A; identical to SEQ ID NO: 6392

SEQ ID NO: 12699 - protein, 386 aa, Escherichia coli DEC6A; identical to SEQ ID NO: 7993

SEQ ID NO: 12700 - protein, 208 aa, Escherichia coli DEC6A; identical to SEQ ID NO: 5717

SEQ ID NO: 12701 - protein, 614 aa, Escherichia coli DEC6A; identical to SEQ ID NO: 6387

SEQ ID NO: 12702 - protein, 446 aa, Escherichia coli DEC6A [sequence omitted]

SEQ ID NO: 12703 - protein, 478 aa, Escherichia coli DEC6A; identical to SEQ ID NO: 5711

SEQ ID NO: 12704 - protein, 774 aa, Escherichia coli DEC6A
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLSPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEIGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 12705 - protein, 368 aa, Escherichia coli DEC6A
MNKTITALTIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNETGKDSTAIDKINAHYFDKKAEDYFFNKFLLSFDPSTQQWSYAGESPWYGTAGAAVVNKGDKTWLINGEAKPGLRTDAVFELDFTGNNLKWNRLAPVSSPDGVAGGFAGISNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 12706 - protein, 121 aa, Escherichia coli DEC6A; identical to SEQ ID NO: 8058

SEQ ID NO: 12707 - protein, 856 aa, Escherichia coli DEC6A
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLVGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 12708 - protein, 816 aa, Escherichia coli DEC6A
MLRTTRWVAAIIFLYSFPGYAEETFDTHFMIGGMRGDKVSEYRFDNKQPLPGNYELDFYVNHQWRGKKDITIPESPAKPCLPKVLLTTLGVKTDNLNTEDNCILLDEAVHGGQYQWDISEHRLNLTIPQAYINELERGYVPPESWDRGIDAFYTSYNLSQYRSYDSNNNSNTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYIIYQKEVPPGPFTIADLQLSGSGADLDVSIKEADGSVRSFLVPYSSVPNMLQPGVSNFDFIAGRSKIYGVKNQEDFLEANYIYGLNNLLTLYGGTILSDNYNAITLGNGWNTPLGAISFDATRSSSKLNNDITHEGTSYQVAYNKYLVQTATRFSVAAWRYASQDYRTFSDHLYENDKHNHQSEYDDFYDIGRKNSLSANIMQPLSNNLGNVSLSALWRNYWGRSGNAKDYQFSYSNSWQRISYTFSASQSYDENDKEEERFNLFISIPFYWGDDITKTRHQINLSNSTSFSKDGYSSNNTGVTGIAGEHDQLNYGIYVNQQQQNNDTSLGTNLSWRTPIAIIDGSYSHSKNTWQSGGSISSGLVVWPGGINITNQLSDTFAILDAPGLEGAHINGQKYNRSNSKGQVVYDLMIPHRENHLVLDIANSESETELQGNRQIIAPYCGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 12709 - protein, 227 aa, Escherichia coli DEC6A
MRIIIALLMSFFILPVHAGVVIYGTRIIYPEKNREVLVQLMNQSKNASLIQAWIDDGNTTIAPEKIQVPFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSNNDITLKNNHASEYELTVVDDYGNNIHSKIAAR

SEQ ID NO: 12710 - protein, 227 aa, Escherichia coli DEC6B; identical to SEQ ID NO: 12709

SEQ ID NO: 12711 - protein, 170 aa, Escherichia coli DEC6B [sequence omitted]

SEQ ID NO: 12712 - protein, 865 aa, Escherichia coli DEC6B; identical to SEQ ID NO: 6375

SEQ ID NO: 12713 - protein, 230 aa, Escherichia coli DEC6B; identical to SEQ ID NO: 8021

SEQ ID NO: 12714 - protein, 747 aa, Escherichia coli DEC6B; identical to SEQ ID NO: 6343

SEQ ID NO: 12715 - protein, 266 aa, Escherichia coli DEC6B; identical to SEQ ID NO: 5772

SEQ ID NO: 12716 - protein, 161 aa, Escherichia coli DEC6B; identical to SEQ ID NO: 5769

SEQ ID NO: 12717 - protein, 221 aa, Escherichia coli DEC6B; identical to SEQ ID NO: 8014

SEQ ID NO: 12718 - protein, 351 aa, Escherichia coli DEC6B; identical to SEQ ID NO: 6367

SEQ ID NO: 12719 - protein, 616 aa, Escherichia coli DEC6B
MGPDVQGKVSIRTITPLNERQYYQLFLNLLEAQGYAVVPVENNVLKVVKSGEAKTEPLPLTGEGHENYVGDEMVTRIVPVRNVSVRELAPVLQQMTDLDGSGSIVNYEPSNVIMLTGRASVVKRLTEVIQRIDREGNRTEEVIPLGNASASEIVRVLESLTRNSSENQPATLKSQIVADERTNSVIVSADPATRDKIRRLIRRLDSEMERSGNSQVFYLKYSKAEDLVDVLKQVSGTLTSAKEEAEGTTGSRREVVSIAASKHSNALIVTAPQDVMQSLQSVIEQLDIRRAQVHVEALIAEVAEGSNINFGVQWMSKDTGFMQFANGTQIPIGSLSMAVSQAKPQKGSTVISENGATTINPDTEGDLSRLSQLLSGFSGTAVGVVKGDWAALVQAVKNDSGTNVLSMPSITTLDNQEAFFMVGQDVPVLTGSAVGENNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 12720 - protein, 223 aa, Escherichia coli DEC6B
MMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 12721 - protein, 869 aa, Escherichia coli DEC6B; identical to SEQ ID NO: 12649

SEQ ID NO: 12722 - protein, 746 aa, Escherichia coli DEC6B; identical to SEQ ID NO: 12650

SEQ ID NO: 12723 - protein, 193 aa, Escherichia coli DEC6B; identical to SEQ ID NO: 6300

SEQ ID NO: 12724 - protein, 360 aa, Escherichia coli DEC6B; identical to SEQ ID NO: 8317

SEQ ID NO: 12725 - protein, 331 aa, Escherichia coli DEC6B; identical to SEQ ID NO: 12652

SEQ ID NO: 12726 - protein, 760 aa, Escherichia coli DEC6B; identical to SEQ ID NO: 6415

SEQ ID NO: 12727 - protein, 203 aa, Escherichia coli DEC6B; identical to SEQ ID NO: 6414

SEQ ID NO: 12728 - protein, 696 aa, Escherichia coli DEC6B
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGGSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 12729 - protein, 361 aa, Escherichia coli DEC6B; identical to SEQ ID NO: 7868

SEQ ID NO: 12730 - protein, 224 aa, Escherichia coli DEC6B; identical to SEQ ID NO: 7705

SEQ ID NO: 12731 - protein, 606 aa, Escherichia coli DEC6B
MYRTHRQHSLLSSGGVPSFIGGLVVFVSAAFNAQAETWFDPAFFKDDPSMVADLSRFEKGQKITPGVYRVDIVLNQTIVDTRNVNFVELTPEKGIAACLTTESLDAMGVNTDAFPAFKQLDKQACALLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGGSWNYSKSRGQPDADQVFALNFSLPLNLLLPRSNDSYTRKKITPG

SEQ ID NO: 12732 - protein, 229 aa, Escherichia coli DEC6B
MALLIFAVLSLLVAGELRAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAIAPCHVAWRAINDYGGLSAKKEQNLP

SEQ ID NO: 12733 - protein, 191 aa, Escherichia coli DEC6B; identical to SEQ ID NO: 5748

SEQ ID NO: 12734 - protein, 232 aa, Escherichia coli DEC6B; identical to SEQ ID NO: 5747

SEQ ID NO: 12735 - protein, 278 aa, Escherichia coli DEC6B
MKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 12736 - protein, 210 aa, Escherichia coli DEC6B; identical to SEQ ID NO: 8964

SEQ ID NO: 12737 - protein, 203 aa, Escherichia coli DEC6B; identical to SEQ ID NO: 6396

SEQ ID NO: 12738 - protein, 207 aa, Escherichia coli DEC6B; identical to SEQ ID NO: 5743

SEQ ID NO: 12739 - protein, 539 aa, Escherichia coli DEC6B; identical to SEQ ID NO: 6391

SEQ ID NO: 12740 - protein, 700 aa, Escherichia coli DEC6B
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTINQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 12741 - protein, 242 aa, Escherichia coli DEC6B; identical to SEQ ID NO: 6420

SEQ ID NO: 12742 - protein, 700 aa, Escherichia coli DEC6B
MLFNFDQANQQLNISIPQAWLAWHSENWAPPSTWKEGVAGVLMDYNLFASSYRPQDGSSSTNLNAYGTAGINAGAWRLRSDYQLNKTDSEDNHDQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISDDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTIHRMSWNDTLDERNSWGMSAGLQSDRPDNGAQVSGNYQHLSSAGEWDISGTYAASDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQLFTVVWGEQSCIIHLPERLEDTTKRLILPCH

SEQ ID NO: 12743 - protein, 430 aa, Escherichia coli DEC6B; identical to SEQ ID NO: 5758

SEQ ID NO: 12744 - protein, 111 aa, Escherichia coli DEC6B; identical to SEQ ID NO: 8122

SEQ ID NO: 12745 - protein, 130 aa, Escherichia coli DEC6B; identical to SEQ ID NO: 7726

SEQ ID NO: 12746 - protein, 395 aa, Escherichia coli DEC6B; identical to SEQ ID NO: 10474

SEQ ID NO: 12747 - protein, 673 aa, Escherichia coli DEC6B; identical to SEQ ID NO: 6170

SEQ ID NO: 12748 - protein, 823 aa, Escherichia coli DEC6B
MTPLASAIVALLFGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKHSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEIPPSVNVAIDKQKGLSCTITFGKEIDESRNYICQ

SEQ ID NO: 12749 - protein, 224 aa, Escherichia coli DEC6B; identical to SEQ ID NO: 6435

SEQ ID NO: 12750 - protein, 641 aa, Escherichia coli DEC6B; identical to SEQ ID NO: 7667

SEQ ID NO: 12751 - protein, 162 aa, Escherichia coli DEC6B; identical to SEQ ID NO: 6365

SEQ ID NO: 12752 - protein, 367 aa, Escherichia coli DEC6B; identical to SEQ ID NO: 12682

SEQ ID NO: 12753 - protein, 192 aa, Escherichia coli DEC6B; identical to SEQ ID NO: 8037

SEQ ID NO: 12754 - protein, 274 aa, Escherichia coli DEC6B; identical to SEQ ID NO: 6362

SEQ ID NO: 12755 - protein, 518 aa, Escherichia coli DEC6B; identical to SEQ ID NO: 6358

SEQ ID NO: 12756 - protein, 793 aa, Escherichia coli DEC6B
MLKKTLLAYTIGFAFSPPANADGIEIAAVDFDRETLKSLGVDPNISHYFSRSARFLPGEYSLIVSVNGEKKGNIATRFDENGDICLDQAFLQQAGLKIPSEEKNGCYDYILSYPGTTITPLPNQEALDIIVSPQAIIPIGLDLTNAATGGTAALLNYSLMSSRAEFSNGSSDYSQAALEGGININDWMLRSHQFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRVDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFAIAKMDNNIAGVRITSQAGPVWTDFRGNAVIPSIQPWRTSGVEIDTASLPKNVDIGNGTKMIKQGRGAVGKVGFSAITQRRALLSITLSDGKKLPRGVAIEDSEGNYLTTSVDDGVVFLNNIKPDMVLDIKDEQQSCRIHLTFPEDAPKDVFYETATGECQ

SEQ ID NO: 12757 - protein, 432 aa, Escherichia coli DEC6B; identical to SEQ ID NO: 5727

SEQ ID NO: 12758 - protein, 359 aa, Escherichia coli DEC6B; identical to SEQ ID NO: 5847

SEQ ID NO: 12759 - protein, 545 aa, Escherichia coli DEC6B
MGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKENVT

SEQ ID NO: 12760 - protein, 834 aa, Escherichia coli DEC6B; identical to SEQ ID NO: 7680

SEQ ID NO: 12761 - protein, 249 aa, Escherichia coli DEC6B
MRYLNTKNIIAAGVLLSCMSSIAWGAIIPDRTRIIMNESDKGEALKLTNQSKNLPYLAQTWIEDTKGNKSRDFIVTVPPMVRLNPSEQIQIRMITQEKIAQLPKDRETLFYFNVRETPPKTDKKNVMQVTMQHALKLFWRPKAIELEDDGVMTYEKVEIIRRNDGSIRFNNKMPYHVTLGYIGTNGVTMLPQTQSLMVTPFSYANTQFKNVPSTFQVGYINDFGGLSFYEINCPVVNNICNISVANRDQ

SEQ ID NO: 12762 - protein, 199 aa, Escherichia coli DEC6B; identical to SEQ ID NO: 8009

SEQ ID NO: 12763 - protein, 838 aa, Escherichia coli DEC6B; identical to SEQ ID NO: 6399

SEQ ID NO: 12764 - protein, 678 aa, Escherichia coli DEC6B; identical to SEQ ID NO: 12695

SEQ ID NO: 12765 - protein, 732 aa, Escherichia coli DEC6B
MMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFIGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 12766 - protein, 650 aa, Escherichia coli DEC6B; identical to SEQ ID NO: 6393

SEQ ID NO: 12767 - protein, 897 aa, Escherichia coli DEC6B; identical to SEQ ID NO: 6392

SEQ ID NO: 12768 - protein, 386 aa, Escherichia coli DEC6B; identical to SEQ ID NO: 7993

SEQ ID NO: 12769 - protein, 208 aa, Escherichia coli DEC6B; identical to SEQ ID NO: 5717

SEQ ID NO: 12770 - protein, 614 aa, Escherichia coli DEC6B; identical to SEQ ID NO: 6387

SEQ ID NO: 12771 - protein, 446 aa, Escherichia coli DEC6B [sequence omitted]

SEQ ID NO: 12772 - protein, 478 aa, Escherichia coli DEC6B; identical to SEQ ID NO: 5711

SEQ ID NO: 12773 - protein, 774 aa, Escherichia coli DEC6B; identical to SEQ ID NO: 12704

SEQ ID NO: 12774 - protein, 216 aa, Escherichia coli DEC6B; identical to SEQ ID NO: 8786

SEQ ID NO: 12775 - protein, 863 aa, Escherichia coli DEC6B
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLVGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 12776 - protein, 784 aa, Escherichia coli DEC6C; identical to SEQ ID NO: 6283

SEQ ID NO: 12777 - protein, 170 aa, Escherichia coli DEC6C [sequence omitted]

SEQ ID NO: 12778 - protein, 865 aa, Escherichia coli DEC6C; identical to SEQ ID NO: 6375

SEQ ID NO: 12779 - protein, 230 aa, Escherichia coli DEC6C; identical to SEQ ID NO: 8021

SEQ ID NO: 12780 - protein, 747 aa, Escherichia coli DEC6C; identical to SEQ ID NO: 6343

SEQ ID NO: 12781 - protein, 266 aa, Escherichia coli DEC6C; identical to SEQ ID NO: 5772

SEQ ID NO: 12782 - protein, 161 aa, Escherichia coli DEC6C; identical to SEQ ID NO: 5769

SEQ ID NO: 12783 - protein, 351 aa, Escherichia coli DEC6C; identical to SEQ ID NO: 6367

SEQ ID NO: 12784 - protein, 184 aa, Escherichia coli DEC6C
MAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 12785 - protein, 548 aa, Escherichia coli DEC6C
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVT

SEQ ID NO: 12786 - protein, 193 aa, Escherichia coli DEC6C; identical to SEQ ID NO: 6300

SEQ ID NO: 12787 - protein, 242 aa, Escherichia coli DEC6C
MTFIKGLPLMLLTISLGCNAVVQPDRTRIVFNANDKATSLRIENQSDKLPYLAYSWIENEKGEKSDALLVALPPIQRLEPKATSQVRVVKQASTTQLPGDRETLFFYNMREIPPAPDKSSDHAILQVAIQSRIKLFWRPAALRKKAGEKVELQLQVSQQGNQLTLKNPTAYYLTIAYLGRNEKGVLPGFKTVMVAPFSTVNTNTGSYSGSQFYLGYMDDYGALRMTTLNCSGQCRLQAVEAK

SEQ ID NO: 12788 - protein, 815 aa, Escherichia coli DEC6C; identical to SEQ ID NO: 6927

SEQ ID NO: 12789 - protein, 430 aa, Escherichia coli DEC6C; identical to SEQ ID NO: 5758

SEQ ID NO: 12790 - protein, 355 aa, Escherichia coli DEC6C
MAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNNQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGMVYQF

SEQ ID NO: 12791 - protein, 331 aa, Escherichia coli DEC6C; identical to SEQ ID NO: 6551

SEQ ID NO: 12792 - protein, 760 aa, Escherichia coli DEC6C; identical to SEQ ID NO: 6415

SEQ ID NO: 12793 - protein, 203 aa, Escherichia coli DEC6C; identical to SEQ ID NO: 6414

SEQ ID NO: 12794 - protein, 361 aa, Escherichia coli DEC6C; identical to SEQ ID NO: 7868

SEQ ID NO: 12795 - protein, 224 aa, Escherichia coli DEC6C
MTVSLTAILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKRKEGNTLKIATKSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 12796 - protein, 591 aa, Escherichia coli DEC6C
MPSFIGGLVVFVSAAFNAQAETWFDPAFFKDDPSMVADLSRFEKGRKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKITPG

SEQ ID NO: 12797 - protein, 128 aa, Escherichia coli DEC6C; identical to SEQ ID NO: 7750

SEQ ID NO: 12798 - protein, 517 aa, Escherichia coli DEC6C
MKHKLQMMKMRWLSAAVMLTLYTSSSWAFSIDDVAKQAQSLAGKGYETPKSNLPSVFRDMKYADYQQILFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 12799 - protein, 232 aa, Escherichia coli DEC6C; identical to SEQ ID NO: 5747

SEQ ID NO: 12800 - protein, 729 aa, Escherichia coli DEC6C
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDCALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQQFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 12801 - protein, 210 aa, Escherichia coli DEC6C; identical to SEQ ID NO: 8964

SEQ ID NO: 12802 - protein, 203 aa, Escherichia coli DEC6C; identical to SEQ ID NO: 6396

SEQ ID NO: 12803 - protein, 565 aa, Escherichia coli DEC6C; identical to SEQ ID NO: 8030

SEQ ID NO: 12804 - protein, 207 aa, Escherichia coli DEC6C; identical to SEQ ID NO: 5743

SEQ ID NO: 12805 - protein, 539 aa, Escherichia coli DEC6C; identical to SEQ ID NO: 6391

SEQ ID NO: 12806 - protein, 646 aa, Escherichia coli DEC6C
MRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGTQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENCKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 12807 - protein, 374 aa, Escherichia coli DEC6C
MTVALSAVAAAVIFAAGAQAAEVYNKDSNKLDLYGRVTALHYFSSDKGNDGDRTYARLGFKGETQINDQLTGFGQWEYQFSGNKTESDGAAGNKTRLAFAGLKFGDFGSIDYGRNYGIAYDVGAYTDVLPEFGGDGWTQTDNFMTARTSGVATYRNTDFFGLVDGLNFAAQYQGKNERDDLQEANGDGYGFSASYEYEGFGIVAAYTNADRTNNQVKGLNGTQTVNGTQTVVDSGSVAKGKHAEMWGTGLKYDANNIYLATIYSETQNMTTFGDKGVADKAQNFEAVLQYQFDFGLRPSLAFLQSRAQDIIVGGKNYGNQDLVKYIDVGTTYYFNKNMSTYVDYKINLIDESQFTQDAGVATDNIVAVGMTYQF

SEQ ID NO: 12808 - protein, 111 aa, Escherichia coli DEC6C; identical to SEQ ID NO: 8122

SEQ ID NO: 12809 - protein, 118 aa, Escherichia coli DEC6C [sequence omitted]

SEQ ID NO: 12810 - protein, 519 aa, Escherichia coli DEC6C
MTVKISGVLKDGTGKPVQNCTIQLKAKRNSTTVVANTVASENPDEAGRYSMDVEYGQYSVILLVEGFPPSHAGTITVYEDSQPGTLNDFLGAMTEDDARPEALRRFELMVEEVVRNAEEAKKNAGEAETSARNAGISASQAEESAENADTSAGDASESARQAAESAASAKQSEEASSSSASAAAQKASESLQSATDAELSKKTAESAAGNAVRDATTATEKARESAESAQSAEQSRIAAEEAVNRIPTVVGPPGPKGEPGPAGPQGPKGDKGERGDTGPAGATGERGPAGDAGPAGPQGPKGDRGETGLTGNAGPQGAKGDTGAAGPAGAQGPKGDKGDPGVAGPAGPAGAPGPKGDKGDPGVAGPAGPAGPQGPKGDTGAPGQGTELLTTANTWTQAQTFNGGINGNLTVTGNGSFNDIQIRSDKRNKRNLVKLDNALDRLEALTGYLYEIQYSADGWQTSVGLIAQDAQKALPELVTEDADVISGEKRLRLNYNGIIALLVEGFKTLRHEIKELREK

SEQ ID NO: 12811 - protein, 395 aa, Escherichia coli DEC6C; identical to SEQ ID NO: 10474

SEQ ID NO: 12812 - protein, 673 aa, Escherichia coli DEC6C; identical to SEQ ID NO: 6170

SEQ ID NO: 12813 - protein, 699 aa, Escherichia coli DEC6C
MSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFGGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLRQELVGQVYYRDESLRFYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYISWAPEPWSLRVQSTTSFDVSDAEGNDINGYTTVDFISSWLLPVGTLSFSVENLFDRDYTTVWGQRAPLYYSPGYGPASLYDYKGRGRTFGLNYSVLF

SEQ ID NO: 12814 - protein, 669 aa, Escherichia coli DEC6C
MIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGGRYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 12815 - protein, 341 aa, Escherichia coli DEC6C
MPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 12816 - protein, 162 aa, Escherichia coli DEC6C; identical to SEQ ID NO: 6365

SEQ ID NO: 12817 - protein, 367 aa, Escherichia coli DEC6C; identical to SEQ ID NO: 12682

SEQ ID NO: 12818 - protein, 250 aa, Escherichia coli DEC6C; identical to SEQ ID NO: 6361

SEQ ID NO: 12819 - protein, 881 aa, Escherichia coli DEC6C; identical to SEQ ID NO: 7317

SEQ ID NO: 12820 - protein, 823 aa, Escherichia coli DEC6C; identical to SEQ ID NO: 12748

SEQ ID NO: 12821 - protein, 224 aa, Escherichia coli DEC6C; identical to SEQ ID NO: 6435

SEQ ID NO: 12822 - protein, 518 aa, Escherichia coli DEC6C; identical to SEQ ID NO: 6358

SEQ ID NO: 12823 - protein, 432 aa, Escherichia coli DEC6C; identical to SEQ ID NO: 5727

SEQ ID NO: 12824 - protein, 359 aa, Escherichia coli DEC6C; identical to SEQ ID NO: 5847

SEQ ID NO: 12825 - protein, 231 aa, Escherichia coli DEC6C; identical to SEQ ID NO: 6400

SEQ ID NO: 12826 - protein, 721 aa, Escherichia coli DEC6C
MDEIPALAEKDDDSVINSLEQIIPGTAAEFDFNHQQLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVSAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 12827 - protein, 678 aa, Escherichia coli DEC6C; identical to SEQ ID NO: 6398

SEQ ID NO: 12828 - protein, 738 aa, Escherichia coli DEC6C
MPGEYSLIVSVNGEKKGNIATRFDENGDICLDQAFLQQAGLKIPSEEKNGCYDYILSYPGTTITPLPNQEALDIIVSPQAIIPIGLDLTNAATGGTAALLNYSLMSSRAEFSNGSSDYSQAALEGGININDWMLRSHQFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRVDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFAIAKMDNNIAGVRITSQAGPVWTDFRGNAVIPSIQPWRTSGVEIDTASLPKNVDIGNGTKMIKQGRGAVGKVGFSAITQRRALLNITLSDGKKLPRGVAIEDSEGNYLTTSVDDGVVFLNNIKPDMVLDIKDEQQSCRIHLTFPEDAPKDVFYETATGECQ

SEQ ID NO: 12829 - protein, 696 aa, Escherichia coli DEC6C
MQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 12830 - protein, 125 aa, Escherichia coli DEC6C
MRYLNTKNIIAAGVLLSCMSSIAWGAIIPDRTRIIMNESDKGEALKLTNQSKNLPYLAQTWIEDTKGNKSRDFIVTVPPMVRLNPSEQIQIRMITQEKIAQLPKDRETLFYFNVREIPPKTDKKM

SEQ ID NO: 12831 - protein, 650 aa, Escherichia coli DEC6C
MKGLNKITCCLLAALLMPCAGHAENEQYGANFNNADIHQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLASLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 12832 - protein, 897 aa, Escherichia coli DEC6C; identical to SEQ ID NO: 6392

SEQ ID NO: 12833 - protein, 386 aa, Escherichia coli DEC6C; identical to SEQ ID NO: 7993

SEQ ID NO: 12834 - protein, 375 aa, Escherichia coli DEC6C
MQLKQRVYNENGKRVDAVVMMDGNVGQQYSTGWFGDNAGGENYMQFSDMYVTTKGFLPFAPEADFWVGKHGAPKIEIQMLDWKTQRTDAAAGVGLENWKVGPGKIDIALVREDVDDYDRSLQNKQQINTNTIDLRYKDIPLWDKATLMVSGRYVTANESASEKDNQDNNGYYDWKDTWMFGTSLTQKFDKGGFNEFSFLVANNSIASNFGRYAGASPFTTFNGRYYGDHTGGTAVRLTSQGEAYIGDHFIVANAIVYSFGNDIYSYETGAHSDFESIRAVVRPAYIWDQYNQTGVELGYFTQQNKDANSNKFNESGYKTTLFHTFKVNTSMLTSRPEIRFYATYIKALENELDGFTFEDNKDDQFAVGAQAEIWW

SEQ ID NO: 12835 - protein, 377 aa, Escherichia coli DEC6C; identical to SEQ ID NO: 9131

SEQ ID NO: 12836 - protein, 208 aa, Escherichia coli DEC6C; identical to SEQ ID NO: 5717

SEQ ID NO: 12837 - protein, 445 aa, Escherichia coli DEC6C
MITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYTGNADNNANFGKAVPADFNGGSFGRGDSDEWTFGAQMEIWW

SEQ ID NO: 12838 - protein, 237 aa, Escherichia coli DEC6C; identical to SEQ ID NO: 6384

SEQ ID NO: 12839 - protein, 224 aa, Escherichia coli DEC6C
MLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 12840 - protein, 856 aa, Escherichia coli DEC6C; identical to SEQ ID NO: 8935

SEQ ID NO: 12841 - protein, 187 aa, Escherichia coli DEC6C
MGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 12842 - protein, 368 aa, Escherichia coli DEC6C
MNKTITALAIMMASFAANASVLPETLVPFKSGTGAIDNDTVYIGLGSAGTAWYKLDTQAKDKKWKALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 12843 - protein, 784 aa, Escherichia coli DEC6D; identical to SEQ ID NO: 6283

SEQ ID NO: 12844 - protein, 170 aa, Escherichia coli DEC6D [sequence omitted]

SEQ ID NO: 12845 - protein, 865 aa, Escherichia coli DEC6D; identical to SEQ ID NO: 6375

SEQ ID NO: 12846 - protein, 230 aa, Escherichia coli DEC6D; identical to SEQ ID NO: 8021

SEQ ID NO: 12847 - protein, 747 aa, Escherichia coli DEC6D; identical to SEQ ID NO: 6343

SEQ ID NO: 12848 - protein, 266 aa, Escherichia coli DEC6D; identical to SEQ ID NO: 5772

SEQ ID NO: 12849 - protein, 161 aa, Escherichia coli DEC6D; identical to SEQ ID NO: 5769

SEQ ID NO: 12850 - protein, 221 aa, Escherichia coli DEC6D; identical to SEQ ID NO: 8014

SEQ ID NO: 12851 - protein, 308 aa, Escherichia coli DEC6D
MSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 12852 - protein, 230 aa, Escherichia coli DEC6D
MMTKIKLLMLIIFYLIISASAHAAGGIALGATRIIYPADAKQTAVWIRNSHTNERFLVNSWIENSSGVKEKSFIITPPLFVSEPKSENTLRIIYTDPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 12853 - protein, 869 aa, Escherichia coli DEC6D; identical to SEQ ID NO: 12649

SEQ ID NO: 12854 - protein, 746 aa, Escherichia coli DEC6D
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTQNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 12855 - protein, 193 aa, Escherichia coli DEC6D; identical to SEQ ID NO: 6300

SEQ ID NO: 12856 - protein, 242 aa, Escherichia coli DEC6D; identical to SEQ ID NO: 6420

SEQ ID NO: 12857 - protein, 815 aa, Escherichia coli DEC6D; identical to SEQ ID NO: 6927

SEQ ID NO: 12858 - protein, 430 aa, Escherichia coli DEC6D; identical to SEQ ID NO: 5758

SEQ ID NO: 12859 - protein, 331 aa, Escherichia coli DEC6D; identical to SEQ ID NO: 6551

SEQ ID NO: 12860 - protein, 760 aa, Escherichia coli DEC6D; identical to SEQ ID NO: 6415

SEQ ID NO: 12861 - protein, 203 aa, Escherichia coli DEC6D; identical to SEQ ID NO: 6414

SEQ ID NO: 12862 - protein, 361 aa, Escherichia coli DEC6D; identical to SEQ ID NO: 7868

SEQ ID NO: 12863 - protein, 166 aa, Escherichia coli DEC6D
MTPDNKKSADFIITPPLFVLNPANENLLRIMYIGAPLAKDRETLFFTSVRAVPSTTKRKEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 12864 - protein, 591 aa, Escherichia coli DEC6D; identical to SEQ ID NO: 12796

SEQ ID NO: 12865 - protein, 128 aa, Escherichia coli DEC6D; identical to SEQ ID NO: 7750

SEQ ID NO: 12866 - protein, 517 aa, Escherichia coli DEC6D; identical to SEQ ID NO: 6406

SEQ ID NO: 12867 - protein, 191 aa, Escherichia coli DEC6D; identical to SEQ ID NO: 5748

SEQ ID NO: 12868 - protein, 232 aa, Escherichia coli DEC6D; identical to SEQ ID NO: 5747

SEQ ID NO: 12869 - protein, 728 aa, Escherichia coli DEC6D
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGLPRWNTDGSSNSYDRARSTAPDWAYNDKEINKVFMTLKQQFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYSTFRAEQGSYALVDLFTRYQVTKNFSLQGNVNNLFDKTYDTNVEGSIVYGTPRNFSITGTYQF

SEQ ID NO: 12870 - protein, 213 aa, Escherichia coli DEC6D; identical to SEQ ID NO: 5744

SEQ ID NO: 12871 - protein, 203 aa, Escherichia coli DEC6D; identical to SEQ ID NO: 6396

SEQ ID NO: 12872 - protein, 207 aa, Escherichia coli DEC6D; identical to SEQ ID NO: 5743

SEQ ID NO: 12873 - protein, 539 aa, Escherichia coli DEC6D; identical to SEQ ID NO: 6391

SEQ ID NO: 12874 - protein, 700 aa, Escherichia coli DEC6D; identical to SEQ ID NO: 6388

SEQ ID NO: 12875 - protein, 118 aa, Escherichia coli DEC6D [sequence omitted]

SEQ ID NO: 12876 - protein, 111 aa, Escherichia coli DEC6D; identical to SEQ ID NO: 8122

SEQ ID NO: 12877 - protein, 826 aa, Escherichia coli DEC6D
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDLAAGRSHIEGASKQSDFVQAGYQYGFNNLLTLYGGSMVANNYYAFTLGAGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQSLTFGYEVNDIHGHNIGVVGQGSQLFIRTNEVPSSVNVAIDKQQGLSCTITFGKEIDESRNYICQ

SEQ ID NO: 12878 - protein, 224 aa, Escherichia coli DEC6D
MKGLLSLLIFSMVLPAHAGIVIYGTRIIYPAENKEVMVQLMNQGNRSSLLQAWIDDGDTSLPPEKTQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWHLTIIDDHGNYISDKI

SEQ ID NO: 12879 - protein, 641 aa, Escherichia coli DEC6D; identical to SEQ ID NO: 7667

SEQ ID NO: 12880 - protein, 162 aa, Escherichia coli DEC6D; identical to SEQ ID NO: 6365

SEQ ID NO: 12881 - protein, 367 aa, Escherichia coli DEC6D; identical to SEQ ID NO: 5789

SEQ ID NO: 12882 - protein, 200 aa, Escherichia coli DEC6D; identical to SEQ ID NO: 6363

SEQ ID NO: 12883 - protein, 274 aa, Escherichia coli DEC6D; identical to SEQ ID NO: 6362

SEQ ID NO: 12884 - protein, 250 aa, Escherichia coli DEC6D; identical to SEQ ID NO: 6361

SEQ ID NO: 12885 - protein, 881 aa, Escherichia coli DEC6D
MPDHSLFRLRILPWCIALAMSGSYSSVWAEDDIQFDSRFLELKGDTKIDLKRFSSQGYVEPGKYNLQVQLNKQPLAEEYHIYWYAGEDDVSKSYACLTPELVAQFGLKEDVAKNLQWSHDGKCLKPGQLEGVEIKADLSQSALVISLPQAYLEYTWPDWDPPSRWDDGISGIIADYSITAQTRHEENGGDDSNEISGNGTVGVNLGPWRMRADWQTNYQHTRSNDDDDEFGGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGGFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNIGTSDKHTSVDGYYSHDGSLAQVDLSANYHEGQYTSAGLSLQGGATLTTHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGSVYLAGVKPGEHMSVFWSGVAHCDINLPDPLPADLFNGLLLPCQHKGNVAPVVPDDIKPVIQEQTQQVTPTDPPVSVSANQ

SEQ ID NO: 12886 - protein, 472 aa, Escherichia coli DEC6D; identical to SEQ ID NO: 5729

SEQ ID NO: 12887 - protein, 355 aa, Escherichia coli DEC6D; identical to SEQ ID NO: 12790

SEQ ID NO: 12888 - protein, 432 aa, Escherichia coli DEC6D; identical to SEQ ID NO: 5727

SEQ ID NO: 12889 - protein, 359 aa, Escherichia coli DEC6D; identical to SEQ ID NO: 5847

SEQ ID NO: 12890 - protein, 696 aa, Escherichia coli DEC6D; identical to SEQ ID NO: 12829

SEQ ID NO: 12891 - protein, 249 aa, Escherichia coli DEC6D
MRYLNTKNIIAAGVLLSCMSSIAWGAIIPDRTRIIMNESDKDEALKLTNQSKNLPYLAQTWIEDTKGNKSRDFIVTVPPMVRLNPSEQIQIRMITQEKIAQLPKDRETLFYFNVREIPPKTDKKNVMQVTMQHALKLFWRPKAIELEDDGVMTYEKVEIIRRNDGSIRFNNKMPYHVTLGYIGTNGVTMLPQTQSLMVTPFSYANTQFKNVPSTFQVGYINDFGGLSFYEINCPVVNNIYNISVANRDQ

SEQ ID NO: 12892 - protein, 231 aa, Escherichia coli DEC6D; identical to SEQ ID NO: 6400

SEQ ID NO: 12893 - protein, 721 aa, Escherichia coli DEC6D; identical to SEQ ID NO: 12826

SEQ ID NO: 12894 - protein, 678 aa, Escherichia coli DEC6D; identical to SEQ ID NO: 6398

SEQ ID NO: 12895 - protein, 683 aa, Escherichia coli DEC6D
MSYPGTTITPLPNQEALDIIVSPQAIIPIGLDLTNAATGGTAALLNYSLMSSRAEFSNGSSDYSQAALEGGININDWMLRSHQFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRVDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFAIAKMDNNIAGVRITSQAGPVWTDFRGNAVIPSIQPWRTSGVEIDTASLPKNVDIGNGTKMIKQGRGAVGKVGFSAITQRRALLNITLSDGKKLPRGVAIEDSEGNYLTTSVDDGVVFLNNIKPDMVLDIKDEQQSCRIHLTFPEDAPKDVFYETATGECQ

SEQ ID NO: 12896 - protein, 650 aa, Escherichia coli DEC6D; identical to SEQ ID NO: 6393

SEQ ID NO: 12897 - protein, 897 aa, Escherichia coli DEC6D; identical to SEQ ID NO: 6392

SEQ ID NO: 12898 - protein, 386 aa, Escherichia coli DEC6D; identical to SEQ ID NO: 7993

SEQ ID NO: 12899 - protein, 200 aa, Escherichia coli DEC6D
MKKIWLALAGLVLAFSASAAQYEDGKQYTTLEKPVAGAPQVLEFFSFFCPHCYQFEEVLHISDNVKKKLPEGVKMTKYHVNFMGGDLGKDLTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSNMDVLFSSMLIQ

SEQ ID NO: 12900 - protein, 540 aa, Escherichia coli DEC6D
MLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGCRFNLSMQHPFQLSLSVF

SEQ ID NO: 12901 - protein, 446 aa, Escherichia coli DEC6D [sequence omitted]

SEQ ID NO: 12902 - protein, 478 aa, Escherichia coli DEC6D; identical to SEQ ID NO: 5711

SEQ ID NO: 12903 - protein, 774 aa, Escherichia coli DEC6D; identical to SEQ ID NO: 8932

SEQ ID NO: 12904 - protein, 121 aa, Escherichia coli DEC6D; identical to SEQ ID NO: 8058

SEQ ID NO: 12905 - protein, 856 aa, Escherichia coli DEC6D; identical to SEQ ID NO: 8935

SEQ ID NO: 12906 - protein, 865 aa, Escherichia coli DEC6E; identical to SEQ ID NO: 6375

SEQ ID NO: 12907 - protein, 246 aa, Escherichia coli DEC6E; identical to SEQ ID NO: 6964

SEQ ID NO: 12908 - protein, 747 aa, Escherichia coli DEC6E; identical to SEQ ID NO: 6343

SEQ ID NO: 12909 - protein, 266 aa, Escherichia coli DEC6E; identical to SEQ ID NO: 5772

SEQ ID NO: 12910 - protein, 161 aa, Escherichia coli DEC6E; identical to SEQ ID NO: 5769

SEQ ID NO: 12911 - protein, 784 aa, Escherichia coli DEC6E; identical to SEQ ID NO: 6283

SEQ ID NO: 12912 - protein, 170 aa, Escherichia coli DEC6E [sequence omitted]

SEQ ID NO: 12913 - protein, 221 aa, Escherichia coli DEC6E; identical to SEQ ID NO: 8014

SEQ ID NO: 12914 - protein, 311 aa, Escherichia coli DEC6E
MHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 12915 - protein, 230 aa, Escherichia coli DEC6E; identical to SEQ ID NO: 12852

SEQ ID NO: 12916 - protein, 869 aa, Escherichia coli DEC6E; identical to SEQ ID NO: 12649

SEQ ID NO: 12917 - protein, 746 aa, Escherichia coli DEC6E; identical to SEQ ID NO: 12854

SEQ ID NO: 12918 - protein, 193 aa, Escherichia coli DEC6E; identical to SEQ ID NO: 6300

SEQ ID NO: 12919 - protein, 242 aa, Escherichia coli DEC6E; identical to SEQ ID NO: 6420

SEQ ID NO: 12920 - protein, 815 aa, Escherichia coli DEC6E; identical to SEQ ID NO: 6927

SEQ ID NO: 12921 - protein, 430 aa, Escherichia coli DEC6E; identical to SEQ ID NO: 5758

SEQ ID NO: 12922 - protein, 360 aa, Escherichia coli DEC6E; identical to SEQ ID NO: 8317

SEQ ID NO: 12923 - protein, 331 aa, Escherichia coli DEC6E; identical to SEQ ID NO: 6551

SEQ ID NO: 12924 - protein, 760 aa, Escherichia coli DEC6E; identical to SEQ ID NO: 6415

SEQ ID NO: 12925 - protein, 673 aa, Escherichia coli DEC6E
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSSSLIVNMPQRWNQDVQELRAATPGDARTVDMVFGLYRQNTREKLNSAYDMPTMPYLSSTGYTTAETLAAYSDLTWHLTDRFDIGGGVRFSHDKSSTQYHGSMLGNPFGDQGKNNDDQVLGQLSAGYMLTDDWRVYTRVAQGYKPSGYNIVPTAGLDAKPFVAEKSINYELGTRYETADVTLQAATFYTHTKDMQLYSGPVRMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERINISVYVDNLFDRRYRTYGYMNGSSDVAQVNMGRTVGINTRIDFF

SEQ ID NO: 12926 - protein, 203 aa, Escherichia coli DEC6E; identical to SEQ ID NO: 6414

SEQ ID NO: 12927 - protein, 361 aa, Escherichia coli DEC6E; identical to SEQ ID NO: 7868

SEQ ID NO: 12928 - protein, 166 aa, Escherichia coli DEC6E; identical to SEQ ID NO: 12863

SEQ ID NO: 12929 - protein, 851 aa, Escherichia coli DEC6E
MPSFIGGLVVFVSAAFNAQAETWFDPAFFKDDPSMVADLSRFEKGRKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGVQANSGIIDDDGSLYMAGLPAKGTISVRWGEAPDQICHINYELTEQQINSAITRMDAICR

SEQ ID NO: 12930 - protein, 130 aa, Escherichia coli DEC6E
MPVDRETLFELSIASVPSGKVENQSVKVAMRSVFKLFWRPEGLPGDPLEAYQQLRWTRNSQGVQLTNPTPYYINLIQVSVNGKALSNVGVVPPKSQRQTSWCQAIAPCHVAWRAINDYGGLSAKKEQNLP

SEQ ID NO: 12931 - protein, 732 aa, Escherichia coli DEC6E; identical to SEQ ID NO: 8819

SEQ ID NO: 12932 - protein, 517 aa, Escherichia coli DEC6E; identical to SEQ ID NO: 6406

SEQ ID NO: 12933 - protein, 191 aa, Escherichia coli DEC6E; identical to SEQ ID NO: 5748

SEQ ID NO: 12934 - protein, 232 aa, Escherichia coli DEC6E; identical to SEQ ID NO: 5747

SEQ ID NO: 12935 - protein, 728 aa, Escherichia coli DEC6E; identical to SEQ ID NO: 12869

SEQ ID NO: 12936 - protein, 213 aa, Escherichia coli DEC6E; identical to SEQ ID NO: 5744

SEQ ID NO: 12937 - protein, 203 aa, Escherichia coli DEC6E; identical to SEQ ID NO: 6396

SEQ ID NO: 12938 - protein, 565 aa, Escherichia coli DEC6E; identical to SEQ ID NO: 8030

SEQ ID NO: 12939 - protein, 207 aa, Escherichia coli DEC6E; identical to SEQ ID NO: 5743

SEQ ID NO: 12940 - protein, 539 aa, Escherichia coli DEC6E; identical to SEQ ID NO: 6391

SEQ ID NO: 12941 - protein, 700 aa, Escherichia coli DEC6E; identical to SEQ ID NO: 6388

SEQ ID NO: 12942 - protein, 426 aa, Escherichia coli DEC6E
MKIRILMLTSLLTFIFPLSSFSAVKQKTPEQISSRVDMSMDNAPLPQVISLIWQRVFNRPFQLSPELAGDTRVVSFYLTQSLEPRSFFISYLKNMGISVSSRNGVDWIYIPAKKEYKEPVSVFTYRPKYRSVSYLSSMLTSVTQSGSFSNHVQTVDYSGSAASSASSASSGSATNSVSAATDAEVLVYSGTVADIRRVRDLLPRIDIPAEQVTVSGYVLEVQTTERNASGLQIIADLFKNRLGVSLGARSEGGNAFTLNVGGLNAFYSLIKTDSRFNVVSNPRLTVLSGSQSQFTVGQEVPVLDSVTYQGNSGSPVQSVTYRNSGAIFTVTPVVLDGVITLDISQQLSDFVKTTTGVNTSPTLTKREISTRVDVNDGDVLVLGGLASSKITKGRSGFSFLPGFTGSSEDSDKTDIIVVLQAHRVLR

SEQ ID NO: 12943 - protein, 111 aa, Escherichia coli DEC6E; identical to SEQ ID NO: 8122

SEQ ID NO: 12944 - protein, 162 aa, Escherichia coli DEC6E; identical to SEQ ID NO: 6365

SEQ ID NO: 12945 - protein, 367 aa, Escherichia coli DEC6E; identical to SEQ ID NO: 5789

SEQ ID NO: 12946 - protein, 130 aa, Escherichia coli DEC6E; identical to SEQ ID NO: 7726

SEQ ID NO: 12947 - protein, 200 aa, Escherichia coli DEC6E; identical to SEQ ID NO: 6363

SEQ ID NO: 12948 - protein, 274 aa, Escherichia coli DEC6E; identical to SEQ ID NO: 6362

SEQ ID NO: 12949 - protein, 250 aa, Escherichia coli DEC6E; identical to SEQ ID NO: 6361

SEQ ID NO: 12950 - protein, 862 aa, Escherichia coli DEC6E
MSGSYSSVWAEDDIQFDSRFLELKGDTKIDLKRFSSQGYVEPGKYNLQVQLNKQPLAEEYHIYWYAGEDDVSKSYACLTPELVAQFGLKEDVAKNLQWSHDGKCLKPGQLEGVEIKADLSQSALVISLPQAYLEYTWPDWDPPSRWDDGISGIIADYSITAQTRHEENGGDDSNEISGNGTVGVNLGPWRMRADWQTNYQHTRSNDDDDEFGGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGGFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNIGTSDKHTSVDGYYSHDGSLAQVDLSANYHEGQYTSAGLSLQGGATLTTHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGSVYLAGVKPGEHMSVFWSGVAHCDINLPDPLPADLFNGLLLPCQHKGNVAPVVPDDIKPVIQEQTQQVTPTDPPVSVSANQ

SEQ ID NO: 12951 - protein, 826 aa, Escherichia coli DEC6E; identical to SEQ ID NO: 12877

SEQ ID NO: 12952 - protein, 224 aa, Escherichia coli DEC6E; identical to SEQ ID NO: 12878

SEQ ID NO: 12953 - protein, 631 aa, Escherichia coli DEC6E; identical to SEQ ID NO: 6430

SEQ ID NO: 12954 - protein, 518 aa, Escherichia coli DEC6E; identical to SEQ ID NO: 6358

SEQ ID NO: 12955 - protein, 432 aa, Escherichia coli DEC6E; identical to SEQ ID NO: 5727

SEQ ID NO: 12956 - protein, 359 aa, Escherichia coli DEC6E; identical to SEQ ID NO: 5847

SEQ ID NO: 12957 - protein, 834 aa, Escherichia coli DEC6E; identical to SEQ ID NO: 7680

SEQ ID NO: 12958 - protein, 249 aa, Escherichia coli DEC6E; identical to SEQ ID NO: 12891

SEQ ID NO: 12959 - protein, 199 aa, Escherichia coli DEC6E; identical to SEQ ID NO: 8009

SEQ ID NO: 12960 - protein, 838 aa, Escherichia coli DEC6E; identical to SEQ ID NO: 6399

SEQ ID NO: 12961 - protein, 678 aa, Escherichia coli DEC6E; identical to SEQ ID NO: 6398

SEQ ID NO: 12962 - protein, 793 aa, Escherichia coli DEC6E; identical to SEQ ID NO: 6397

SEQ ID NO: 12963 - protein, 897 aa, Escherichia coli DEC6E; identical to SEQ ID NO: 6392

SEQ ID NO: 12964 - protein, 650 aa, Escherichia coli DEC6E; identical to SEQ ID NO: 6393

SEQ ID NO: 12965 - protein, 386 aa, Escherichia coli DEC6E; identical to SEQ ID NO: 7993

SEQ ID NO: 12966 - protein, 208 aa, Escherichia coli DEC6E; identical to SEQ ID NO: 5717

SEQ ID NO: 12967 - protein, 614 aa, Escherichia coli DEC6E; identical to SEQ ID NO: 6387

SEQ ID NO: 12968 - protein, 237 aa, Escherichia coli DEC6E; identical to SEQ ID NO: 6384

SEQ ID NO: 12969 - protein, 863 aa, Escherichia coli DEC6E; identical to SEQ ID NO: 8863

SEQ ID NO: 12970 - protein, 241 aa, Escherichia coli DEC6E; identical to SEQ ID NO: 6143

SEQ ID NO: 12971 - protein, 368 aa, Escherichia coli DEC6E; identical to SEQ ID NO: 8795

SEQ ID NO: 12972 - protein, 774 aa, Escherichia coli DEC6E; identical to SEQ ID NO: 8932

SEQ ID NO: 12973 - protein, 446 aa, Escherichia coli DEC6E [sequence omitted]

SEQ ID NO: 12974 - protein, 1024 aa, Escherichia coli DEC7A
MTTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNILGGGAENIGDNLGKAGGILSTFQNFLGTALSSMKIDELIKKQKSGGNVSSSEMAEASIELINQLVDTVASLNNNVNSFSQQLNTLGSVLSNTKHLNGVGNKLQNLPNLDNIGAGLDTVSGILSAISASFILSNADADTRTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGAVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDLIEGNDGNDRLYGDKGNDTLIGGNGDDQLYGGDGNDKLIGGAGNNYLNGGDGDDELQVQGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGNFDVKEERTAASLLQLSGNASDFSYGRNSITLTTSA

SEQ ID NO: 12975 - protein, 120 aa, Escherichia coli DEC7A
MDAVLSVQGASAPVKKKSFFSKFTRLNMLRLVRAVLPAAVLMMFFPQLAMASGSQDLMASGNSTVKATFGKDSSVVKWVVLAEVLVGAVMYMMTKNVKFLAGFAIISVFIAVGMAVVGLK

SEQ ID NO: 12976 - protein, 67 aa, Escherichia coli DEC7A
MVIITFKSGETFQVEVPGSQHIDSQKKAIERMKDTLRITYLTETKIDKLCVWNNKTPNSIAAISMKN

SEQ ID NO: 12977 - protein, 218 aa, Escherichia coli DEC7A
MPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLREYQSKVKRQIFSDYQSEVDIYNRIRDEL

SEQ ID NO: 12978 - protein, 241 aa, Escherichia coli DEC7A; identical to SEQ ID NO: 6143

SEQ ID NO: 12979 - protein, 856 aa, Escherichia coli DEC7A; identical to SEQ ID NO: 9540

SEQ ID NO: 12980 - protein, 784 aa, Escherichia coli DEC7A
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNSL

SEQ ID NO: 12981 - protein, 170 aa, Escherichia coli DEC7A [sequence omitted]

SEQ ID NO: 12982 - protein, 765 aa, Escherichia coli DEC7A
MQFHINSPDINNEKAVLLARDETLGNCLNLTEIIPQTSVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARLSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIE

SEQ ID NO: 12983 - protein, 246 aa, Escherichia coli DEC7A; identical to SEQ ID NO: 6342

SEQ ID NO: 12984 - protein, 729 aa, Escherichia coli DEC7A
MARSKTAQPKHSLRKIAVVVATAVSGMSVYAQAAVEPKEDTITVTAAPAPQESAWGPAATIAAKHSATATKTDTPIEKTPQSISVVTNEEMQMHQFQSVKEALGYTPGVTVSSRGASNTYDFVIIRGFSSVGLNQNNYLDGLKLQGNFYNDAVIDPYMLERVELMRGPTSVLYGKSNPGGIISMVSKRPTTEPLKEIQFKMGTDNLFQTGFDFSDALDDNGEFSYRLTGLARSTNEQQKNSESQRYTIAPSFSWRPDDKTNFTFLSYFQNEPETGYYGWLPKEGTVEPLPNGKRLPTDFNEGASNNTYSRNQKMVGYSFEHGFNDTFTVRQNLRFSEMKTSQKSVYGTGIANDGHTLNRGTVVDNERLQNFSVDTQLESKFATGEVEHTLLTGVDFMRMRNDINASFGSAPSIDLYNKYHPEYFAFGNAEPYQMNESKQTGIYVQDQAEWNKWVFTLGGRYDWSKQATTVRENSYTPTEGYIERNDHQFTWRGGVNYLFDNGISPYFSYSQSFEPSAFDLWSNPRVSYKPSKGEQYEAGVKYVPNDMPVVVTGAVYQLTKTNNLTADPTNPLAQVPAGEIRARGVELEAKAALNANINLTASYTYTDAEYTKDTNLKGKTPEQVPEHMASLWGDYTFNEGPLSGLTLGTGGRFIGSSYGDPANTFKVGSAAVMDAVVKYDLARFGMAGSSLAVNVNNLLDREYVASCFQTYGCFWGAERQVVATATFRF

SEQ ID NO: 12985 - protein, 266 aa, Escherichia coli DEC7A; identical to SEQ ID NO: 5772

SEQ ID NO: 12986 - protein, 161 aa, Escherichia coli DEC7A; identical to SEQ ID NO: 5769

SEQ ID NO: 12987 - protein, 728 aa, Escherichia coli DEC7A
MTPQDSNELCLTEAWLTKAGVYVSADYFREGYDATRQCYVLTKAPSVKVDFDVSTQSLALSIPQKGLVKMPENVDWDYGTSAFRVNYNANANTGRNNTSAFGSADLKANIGHWVVSSSATASGGDSGDNSTTINMFTATRAIRALSADLAVGKTSTGDSLLGSTGTYGVSLSRNNSMKPGNLGYTPVFSGIANGPSRVTLTQNGRLLHSEMVPAGPFSITDVPLYTSGDVTMKITGEDGREQVQNFPLSVMAGQLSPGQHEFSVAAGLPDDDSDLKGGVFAASYGYGLDGLTLRAGGVFNQDWQGASAGVVAGLGYLGAVSADGAYATAKYRDGSHSGNKVQLSWSKQLETTNTGLRVSWSRQSEEYEGMSSFDPTELWSQSNHGRRTKDEWNAGISQPVGGLFSLSVSGWQRSYYPASMTGSYRYSDDNGKETGITGSLSTQIKGVSLNLGWSGSRNSRGENNWSASASVSVPFTLFDRRYSSSASVSTSKGGGTGFSTGVSGSLNDRFSYGLGGGRDGDGGTSSYLNASYSGDRAYLNGVLNHSQSGGTSGSVSVSGSVLAVPAAKDIMFSRTTGDTVAVVNVKDTPGVKVTSGDGQTDSDGNLVVPLNSYDWNTVTIDAGTLPLSTELTNTSQKVVPTDKAVVWMPFDALKVKRYLLQVKQRDGEFVPGGTWARDSKNTPLGFVANNGVLMINTVDAPGDITLGQCRIPAARLQDTEKLQEITCE

SEQ ID NO: 12988 - protein, 258 aa, Escherichia coli DEC7A; identical to SEQ ID NO: 6001

SEQ ID NO: 12989 - protein, 351 aa, Escherichia coli DEC7A; identical to SEQ ID NO: 5767

SEQ ID NO: 12990 - protein, 230 aa, Escherichia coli DEC7A; identical to SEQ ID NO: 6294

SEQ ID NO: 12991 - protein, 820 aa, Escherichia coli DEC7A
MKIPTTTDIPQRYTWCLAGICYSSLAILPSFLSYAESYFNPAFLLENGTSVADLSRFERGNHQPARVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSEFSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYATLGVGYNYDRDQHDVNWQLSGGVVGHENGITLSQPFGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSIGITSMWVMTGKFI

SEQ ID NO: 12992 - protein, 746 aa, Escherichia coli DEC7A; identical to SEQ ID NO: 7355

SEQ ID NO: 12993 - protein, 193 aa, Escherichia coli DEC7A; identical to SEQ ID NO: 6300

SEQ ID NO: 12994 - protein, 430 aa, Escherichia coli DEC7A; identical to SEQ ID NO: 5758

SEQ ID NO: 12995 - protein, 331 aa, Escherichia coli DEC7A
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLILAGYRDEEIAQAAAAVKQAQAAYDYAQNFYNRQQGLWKSRTISANDLENARSSRDQAQATLKSAQDKLRQYRSGNREQDIAQTKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGNEAGHE

SEQ ID NO: 12996 - protein, 760 aa, Escherichia coli DEC7A
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLMNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 12997 - protein, 203 aa, Escherichia coli DEC7A; identical to SEQ ID NO: 6414

SEQ ID NO: 12998 - protein, 361 aa, Escherichia coli DEC7A; identical to SEQ ID NO: 7868

SEQ ID NO: 12999 - protein, 136 aa, Escherichia coli DEC7A
MYIGAPLAKDRETLFFTSVRAVPSTTKREEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 13000 - protein, 851 aa, Escherichia coli DEC7A
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVCDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 13001 - protein, 229 aa, Escherichia coli DEC7A; identical to SEQ ID NO: 6442

SEQ ID NO: 13002 - protein, 191 aa, Escherichia coli DEC7A; identical to SEQ ID NO: 5748

SEQ ID NO: 13003 - protein, 232 aa, Escherichia coli DEC7A; identical to SEQ ID NO: 5747

SEQ ID NO: 13004 - protein, 729 aa, Escherichia coli DEC7A
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGIYELFGRQHNLMFGGSYSKQNNCYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 13005 - protein, 213 aa, Escherichia coli DEC7A; identical to SEQ ID NO: 5744

SEQ ID NO: 13006 - protein, 360 aa, Escherichia coli DEC7A; identical to SEQ ID NO: 8317

SEQ ID NO: 13007 - protein, 243 aa, Escherichia coli DEC7A; identical to SEQ ID NO: 6463

SEQ ID NO: 13008 - protein, 816 aa, Escherichia coli DEC7A
MNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTTGINAGAWRLRSDYQLNQTDSDDNHEQSGGISRTYLFRPLPQLGSKLTLGETDFSSNIFDGFSYTGAALASDERMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 13009 - protein, 203 aa, Escherichia coli DEC7A; identical to SEQ ID NO: 6347

SEQ ID NO: 13010 - protein, 207 aa, Escherichia coli DEC7A
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLNEITYSQNGKNWKVVYGGYDTKTQPAMPANMELTDGGQRIKLKMDNWIVK

SEQ ID NO: 13011 - protein, 539 aa, Escherichia coli DEC7A; identical to SEQ ID NO: 6525

SEQ ID NO: 13012 - protein, 700 aa, Escherichia coli DEC7A
MKIFSVRQTVLPALLVLSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 13013 - protein, 236 aa, Escherichia coli DEC7A; identical to SEQ ID NO: 6472

SEQ ID NO: 13014 - protein, 111 aa, Escherichia coli DEC7A; identical to SEQ ID NO: 7885

SEQ ID NO: 13015 - protein, 118 aa, Escherichia coli DEC7A [sequence omitted]

SEQ ID NO: 13016 - protein, 673 aa, Escherichia coli DEC7A; identical to SEQ ID NO: 6170

SEQ ID NO: 13017 - protein, 341 aa, Escherichia coli DEC7A
MPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSFNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 13018 - protein, 162 aa, Escherichia coli DEC7A; identical to SEQ ID NO: 5896

SEQ ID NO: 13019 - protein, 367 aa, Escherichia coli DEC7A; identical to SEQ ID NO: 5784

SEQ ID NO: 13020 - protein, 200 aa, Escherichia coli DEC7A; identical to SEQ ID NO: 6311

SEQ ID NO: 13021 - protein, 518 aa, Escherichia coli DEC7A; identical to SEQ ID NO: 6358

SEQ ID NO: 13022 - protein, 224 aa, Escherichia coli DEC7A; identical to SEQ ID NO: 6302

SEQ ID NO: 13023 - protein, 274 aa, Escherichia coli DEC7A; identical to SEQ ID NO: 6489

SEQ ID NO: 13024 - protein, 250 aa, Escherichia coli DEC7A; identical to SEQ ID NO: 6317

SEQ ID NO: 13025 - protein, 881 aa, Escherichia coli DEC7A
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEEFSGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 13026 - protein, 432 aa, Escherichia coli DEC7A; identical to SEQ ID NO: 5727

SEQ ID NO: 13027 - protein, 834 aa, Escherichia coli DEC7A
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGSSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 13028 - protein, 249 aa, Escherichia coli DEC7A; identical to SEQ ID NO: 6450

SEQ ID NO: 13029 - protein, 231 aa, Escherichia coli DEC7A
MSKRTFAVIITLLCSFCIGQALAGGIVLQRTRVIYDASRKEAALPVANKGAETPYLLQSWVDNIDGTSRAPFIITPPLFRLEAGDDSSLRIIKTADNLPENKESLFYINVRAIPAKKKSDNVNANELTLVFKTRIKMFYRPAHLKGRVNDAWKSLEFKRSDHSLNIYNPTEYYVVFAGLAVDKTDLTSKIEYIAPGEHKQLPLPASGGKNVKWAAINDYGGSSGTETRPLQ

SEQ ID NO: 13030 - protein, 429 aa, Escherichia coli DEC7A
MPQRHHQGHKRTPKQLALIIKRCLPMVLTGSGMLCITANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYSGLLGSEDYYALGIGIGGTLGRLAP

SEQ ID NO: 13031 - protein, 678 aa, Escherichia coli DEC7A
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQELLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 13032 - protein, 359 aa, Escherichia coli DEC7A; identical to SEQ ID NO: 5847

SEQ ID NO: 13033 - protein, 686 aa, Escherichia coli DEC7A; identical to SEQ ID NO: 6453

SEQ ID NO: 13034 - protein, 654 aa, Escherichia coli DEC7A
MDCVMKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYHSLSKEKYTRYRQEQQQRIDGKSKALVGSEDLPVLDENTFNSHAPAPSSR

SEQ ID NO: 13035 - protein, 903 aa, Escherichia coli DEC7A
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKSNDASNPWRYVRAATATEISETSNPQSCTSAPQPSPDVKPAPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGGAVTPVDPTPETPVTPTPDNNEPSTPADSGNDYSLQTWSGQEGSEIYHVIFNGNVYKNAWWVGSKDCPRGTSAENSNNPWRLVRTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLKVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 13036 - protein, 386 aa, Escherichia coli DEC7A
MVDDVPVAQVLQALAEQEKLNLVVSPDVSGTVSLHLTDVPWKQALQTVVKSAGLITRQEDNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLCVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 13037 - protein, 370 aa, Escherichia coli DEC7A
MKKITVALSAVAASVLMAMSAQAAEIYNKDGNKLDLYGKVNAEHYFSSSASDDGDKTYARMGFKGETQINDQLTGFGQWEYEFKGNRTETEGSDKDKTRLAFAGLRFGDYGSLDYGRNYGVAYDVGAWTDVLPEFGGDTWTQTDVFMTQRATGVATYRNNDFFGLVDGLNFALQYQGKNDSAAKVNNWKGRDVVESNGDGFGLSATYDYEGFGIGATYAKSDRTDGQVSYANASSLNASGKTAEVWATGLKYDANNIYLAATYSETQNMTVFGDDFIANKAKNFEAVAQYQFDFGLRPSIAYLHSRGENIGAFGNQDLVEYIDVGATYYFNKNMSAFVDYKINLIDESEFTKASEVATDNIVAVGMTYQF

SEQ ID NO: 13038 - protein, 45 aa, Escherichia coli DEC7A; identical to SEQ ID NO: 10025

SEQ ID NO: 13039 - protein, 243 aa, Escherichia coli DEC7A
MSRKSCLIRLFKTTVSCKLFTAIILSVFLGQPALTYAGVVIGGTRVVYLSNNADKSISVFSKEEKIPYLIQGWVDPFNKEDKSKAPFTVIPPVSRLEPSQEKILRIIHTKGVSLPDDRESVFWLNIKNIPPSASNKATNSLEIAVKTRIKLFWRPANIRLIPEDAAPKVKWRREGRNLIAENPNPIHISVMDVIVDGHDVPLNMIRPFETLTLPLPANSAGGQMTWRFINDYGAVSDPIKMTL

SEQ ID NO: 13040 - protein, 208 aa, Escherichia coli DEC7A; identical to SEQ ID NO: 5717

SEQ ID NO: 13041 - protein, 614 aa, Escherichia coli DEC7A; identical to SEQ ID NO: 7971

SEQ ID NO: 13042 - protein, 446 aa, Escherichia coli DEC7A; identical to SEQ ID NO: 6459

SEQ ID NO: 13043 - protein, 237 aa, Escherichia coli DEC7A
MRKITQAISAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPVTNMNPVIFAGDKPGQNTKSQWLQDKNIRIFYGDSDNDITAARDVDARGIRILRASNSTYKPLPQAGAFGEEVIVNSEY

SEQ ID NO: 13044 - protein, 774 aa, Escherichia coli DEC7A
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIASYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 13045 - protein, 368 aa, Escherichia coli DEC7A; identical to SEQ ID NO: 7728

SEQ ID NO: 13046 - protein, 161 aa, Escherichia coli DEC7B; identical to SEQ ID NO: 5769

SEQ ID NO: 13047 - protein, 784 aa, Escherichia coli DEC7B; identical to SEQ ID NO: 6283

SEQ ID NO: 13048 - protein, 170 aa, Escherichia coli DEC7B [sequence omitted]

SEQ ID NO: 13049 - protein, 865 aa, Escherichia coli DEC7B
MTIEYTKNYHHLTRIATFCALLYCNSTFSAELVEYDHTFLMGQNASNIDLSRYSEGNPAIPGVYDVSVYVNDQPIINQSITFVAVEGKKNAQACITLKNLLQFHINSPDINNEKAVLLARDETLGNCLNLTEIIPQASVRYDVNDQRLDIDVPQAWVMKNYQNYVDPSLWENGINAAMLSYNLNGYHSETPGRRNDSIYAAFNGGMNLGAWRLRASGNYNWMTDSGSNYDFKNRYVQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 13050 - protein, 246 aa, Escherichia coli DEC7B
MFFNTKHTTALCFVTCMTFSSSSIADIVISGTRVIYKSDQKSVNVRLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVNGLNGKASSAKVHFYAINDFGGAIEGNARL

SEQ ID NO: 13051 - protein, 747 aa, Escherichia coli DEC7B
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGLLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 13052 - protein, 266 aa, Escherichia coli DEC7B; identical to SEQ ID NO: 5772

SEQ ID NO: 13053 - protein, 351 aa, Escherichia coli DEC7B
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNESRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 13054 - protein, 230 aa, Escherichia coli DEC7B
MMTQIKLLMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 13055 - protein, 867 aa, Escherichia coli DEC7B
MKIPTTTDIPQRYTWCLAGICYSSLAILPSFLSYAESYFNPAFLLENGTSVADLSRFERGNHQPAGVYWVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADASRHEGDSIRFLYAKSMNTFGTNFQLMGYRYSTQGFYTLDDVAYRRMEGYEYDYDGEHRDEPIIVNYHNLRFSRKDRLQLNVSQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGGGYNYDRDQHDVNWQLSGGVVGHENGITLSQPLGDTNVLIKAPGAGGVRIENQTGILTDWRGYAVMLYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 13056 - protein, 746 aa, Escherichia coli DEC7B; identical to SEQ ID NO: 6561

SEQ ID NO: 13057 - protein, 193 aa, Escherichia coli DEC7B; identical to SEQ ID NO: 6300

SEQ ID NO: 13058 - protein, 242 aa, Escherichia coli DEC7B; identical to SEQ ID NO: 6420

SEQ ID NO: 13059 - protein, 815 aa, Escherichia coli DEC7B; identical to SEQ ID NO: 6927

SEQ ID NO: 13060 - protein, 430 aa, Escherichia coli DEC7B; identical to SEQ ID NO: 5758

SEQ ID NO: 13061 - protein, 331 aa, Escherichia coli DEC7B; identical to SEQ ID NO: 6551

SEQ ID NO: 13062 - protein, 760 aa, Escherichia coli DEC7B; identical to SEQ ID NO: 6415

SEQ ID NO: 13063 - protein, 203 aa, Escherichia coli DEC7B; identical to SEQ ID NO: 6414

SEQ ID NO: 13064 - protein, 361 aa, Escherichia coli DEC7B; identical to SEQ ID NO: 7868

SEQ ID NO: 13065 - protein, 224 aa, Escherichia coli DEC7B; identical to SEQ ID NO: 7705

SEQ ID NO: 13066 - protein, 591 aa, Escherichia coli DEC7B; identical to SEQ ID NO: 7988

SEQ ID NO: 13067 - protein, 130 aa, Escherichia coli DEC7B; identical to SEQ ID NO: 12930

SEQ ID NO: 13068 - protein, 232 aa, Escherichia coli DEC7B; identical to SEQ ID NO: 5747

SEQ ID NO: 13069 - protein, 729 aa, Escherichia coli DEC7B; identical to SEQ ID NO: 6402

SEQ ID NO: 13070 - protein, 213 aa, Escherichia coli DEC7B; identical to SEQ ID NO: 5744

SEQ ID NO: 13071 - protein, 517 aa, Escherichia coli DEC7B; identical to SEQ ID NO: 6406

SEQ ID NO: 13072 - protein, 191 aa, Escherichia coli DEC7B; identical to SEQ ID NO: 5748

SEQ ID NO: 13073 - protein, 203 aa, Escherichia coli DEC7B; identical to SEQ ID NO: 6396

SEQ ID NO: 13074 - protein, 565 aa, Escherichia coli DEC7B; identical to SEQ ID NO: 6395

SEQ ID NO: 13075 - protein, 207 aa, Escherichia coli DEC7B; identical to SEQ ID NO: 5743

SEQ ID NO: 13076 - protein, 539 aa, Escherichia coli DEC7B
MAAVCGTSGIASLFSQAAFAADSDIADGQTQRFDFSILQSMAHDLAQTVWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFSEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 13077 - protein, 700 aa, Escherichia coli DEC7B; identical to SEQ ID NO: 7984

SEQ ID NO: 13078 - protein, 871 aa, Escherichia coli DEC7B
MHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVITVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 13079 - protein, 236 aa, Escherichia coli DEC7B; identical to SEQ ID NO: 6472

SEQ ID NO: 13080 - protein, 387 aa, Escherichia coli DEC7B
MKRKVLAMLVPALLVAGAANAAEIYNKDGNKLDLYGKVDARHTFSDNPGDDGDETIIELGFKGETQITDQLTGYGQALTKTKASDTEGSDNTYVKLAFAGLKFGEMGSFDYGRNYGVIYDVEAWTDMLPVFGGDSYTWTDNFMAGRANGVATYRNSDFFGLVEGLNFALQYQGNNEGSNAGEDQEGTKNGHEDVRFQNGDGFGLSTSYDFDFGLSLGAAYSNSDRTNSQVALGGYHYNEYSKFAGGDTAEAWTFGAKYDANNVYLAMMYAETRNMTPYGNVGIANKTQNFEAVAQYQFDFGLRPSLAYVYSKGKDLGGNDYNNNGHQEYVDQDLVNYVEIGATYYFNKNFSTYVDYKINLLDKDDDFYDNNGIATDDVVGVGLVYQF

SEQ ID NO: 13081 - protein, 111 aa, Escherichia coli DEC7B; identical to SEQ ID NO: 7676

SEQ ID NO: 13082 - protein, 118 aa, Escherichia coli DEC7B [sequence omitted]

SEQ ID NO: 13083 - protein, 162 aa, Escherichia coli DEC7B; identical to SEQ ID NO: 6365

SEQ ID NO: 13084 - protein, 376 aa, Escherichia coli DEC7B
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDILPEFGGDTYGSDNFMQQRGNGFATYRNTDFFGLVDGLNFAVQYQGKNGSVSGEGMTNNGRGALRQNGDGVGGSITYDYEGFGIGAAVSSSKRTDDQNGSYTSNGVVRNYIGTGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 13085 - protein, 826 aa, Escherichia coli DEC7B
MLRMTPLASAIVALLLGIEAYAAEETFDTHFMIGGMKDQQVANIRLNDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTFYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDLAAGRSHIEGASKQSDFVQAGYQYGFNNLLTLYGGSMVANNYYAFTLGAGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQSLTFGYEVNDIHGHNIGVVGQGSQLFIRTNEVPSSVNVAIDKQQGLSCTITFGKEIDESRNYICQ

SEQ ID NO: 13086 - protein, 224 aa, Escherichia coli DEC7B; identical to SEQ ID NO: 6372

SEQ ID NO: 13087 - protein, 631 aa, Escherichia coli DEC7B
MVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTFDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 13088 - protein, 274 aa, Escherichia coli DEC7B; identical to SEQ ID NO: 6362

SEQ ID NO: 13089 - protein, 250 aa, Escherichia coli DEC7B
MSDLLCSAKLGATTLALLLSAASLSAQASVTPDRTRLIFNESDKSISVTLRNNDPKLPYLAQSWIEDEKGNKISSPLTVLPPVQRIDSMMNGQVKVQGMPDINKLPADRESLFYFNVREIPPKSNKANTLQIALQTRIKLFWRPKALEKVSMKSPWQHKVTLTRSGQDFTVNNPTPYYVIISNASAQKKGNPAAGFSPLVIEPKTTVPLNVKMDSVPVLTYVNDFGARMPLFFKCNGNSCQVDEEQSRKG

SEQ ID NO: 13090 - protein, 881 aa, Escherichia coli DEC7B
MPDHSLFRLRILPWCIALAISGSYSSVWAEDDIQFDSRFLELKGDTKIDLKRFSSQGYVEPGKYNLQVQLNKQPLAEEYDIYWYAGEDDVSKSYACLTPELVAQFGLKEDVAKNLQWSHDGKCLKPGQLEGMEIKADLSQSALVISLPQAYLEYTWPDWDPPSRWDDGISGIIADYSITAQTRHEENGGDDSNEISGNGTVGVNLGPWRMRADWQTNYQHTRSNDDDEEFSGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 13091 - protein, 200 aa, Escherichia coli DEC7B; identical to SEQ ID NO: 6363

SEQ ID NO: 13092 - protein, 518 aa, Escherichia coli DEC7B
MKKLKINYLFIGILALLLAVALWPSIPWFGKVDNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 13093 - protein, 432 aa, Escherichia coli DEC7B; identical to SEQ ID NO: 5727

SEQ ID NO: 13094 - protein, 359 aa, Escherichia coli DEC7B; identical to SEQ ID NO: 5847

SEQ ID NO: 13095 - protein, 793 aa, Escherichia coli DEC7B
MLKKTLLAYTIGFAFSPPANADGIEIAAVDFDRETLKSLGVDPNISHYFSRSARFLPGEYSLAVSVNGEKKGNIATRFDENGDICLDQAFLQQAGLKIPSEEKNGCYDYILSYPGTTITPLPNQEALDIIVSPQAIIPIGLDLTNAATGGTAALLNYSLMSSRAEFSNGSSDYSQAALEGGININDWMLRSHQFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRVDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFAIAKMDNNIAGVRITSQAGPVWTDFRGNAVIPSIQPWRTSGVEIDTASLPKNVDIGNGTKMIKQGRGAVGKVGFSAITQRRALLNITLSDGKKLPRGVAIEDSEGNYLTTSVDDGVVFLNNIKPDMVLDIKDEQQSCRIHLTFPEDAPKDVFYETATGECQ

SEQ ID NO: 13096 - protein, 822 aa, Escherichia coli DEC7B
MIKNIYCSLSVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 13097 - protein, 249 aa, Escherichia coli DEC7B; identical to SEQ ID NO: 6407

SEQ ID NO: 13098 - protein, 199 aa, Escherichia coli DEC7B; identical to SEQ ID NO: 8009

SEQ ID NO: 13099 - protein, 838 aa, Escherichia coli DEC7B; identical to SEQ ID NO: 6399

SEQ ID NO: 13100 - protein, 678 aa, Escherichia coli DEC7B; identical to SEQ ID NO: 6398

SEQ ID NO: 13101 - protein, 650 aa, Escherichia coli DEC7B; identical to SEQ ID NO: 6393

SEQ ID NO: 13102 - protein, 897 aa, Escherichia coli DEC7B; identical to SEQ ID NO: 6392

SEQ ID NO: 13103 - protein, 386 aa, Escherichia coli DEC7B
MVDDVPVAQVLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGVIPWFGQLFRHDGKEDERRELVVFITPRLVSNE

SEQ ID NO: 13104 - protein, 45 aa, Escherichia coli DEC7B; identical to SEQ ID NO: 10025

SEQ ID NO: 13105 - protein, 475 aa, Escherichia coli DEC7B
MNRSVSTNDQGYAANPFPTSSAAKPDAVLVKNEEKNASETGSIYSSMTLKDFSKFVKDEIGFSYNGYYRSGWGTASHGSPKSWAIGSLGRFGNEYSGWFDLQLKQRVYNENGKRVDAVVMMDGNVGQQYSTGWFGDNAGGENFMQFSDMYVTTKGFLPFAPEADFWVGKHGAPKIEIQMLDWKTQRTDAAAGVGLENWKVGPGKIDIALVREDVDDYDRSLQNKQQINTNTIDLRYKDIPLWDKATLMVSGRYVTANESASEKDNQDNNGYYDWKDTWMFGTSLTQKFDKGGFNEFSFLVANNSIASNFGRYAGASPFTTFNGRYYGDHTGGTAVRLTSQGEAYIGDHFIVANAIVYSFGNDIYSYETGAHSDFESIRAVVRPAYIWDQYNQTGVELGYFTQQNKDANSNKFNESGYKTTLFHTFKVNTSMLTSRPEIRFYATYIKALENELDGFTFEDNKDDQFAVGAQAEIWW

SEQ ID NO: 13106 - protein, 243 aa, Escherichia coli DEC7B; identical to SEQ ID NO: 6145

SEQ ID NO: 13107 - protein, 208 aa, Escherichia coli DEC7B; identical to SEQ ID NO: 5717

SEQ ID NO: 13108 - protein, 446 aa, Escherichia coli DEC7B; identical to SEQ ID NO: 8470

SEQ ID NO: 13109 - protein, 774 aa, Escherichia coli DEC7B
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGHLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYNDNNKGIYAGQPRTLYMQGSLKF

SEQ ID NO: 13110 - protein, 368 aa, Escherichia coli DEC7B
MNKTITALAIMMASFAANASVLPETPVPFKSGTGAIDNDTVYIGLGSAGTAWYKLDTQAKDKKWKALAAFPGGPRDQATSAFIDGNLYVFGGIGKNSEGLTQVFNDVHKYNPKTNSWVKLMSHAPVGMAGHVTFVHNGKAYVTGGVNQNIFNGYFEDLNEAGKDQTAVDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGVSNDSLIFAGGAGFKGSRENYQNGKNYAHEGLKKSYSADIHLWHNGKWDKSGELSQGRAYGVSLPWNNSLLIIGGETAGGKAVTDSVLITVKDNKVTVQN

SEQ ID NO: 13111 - protein, 241 aa, Escherichia coli DEC7B; identical to SEQ ID NO: 6143

SEQ ID NO: 13112 - protein, 863 aa, Escherichia coli DEC7B
MHIRKHRLAGFFVRLVVACAFAAQAPLSSADLYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPFLQREGHTRYSITAGEYRSGNAQQEKTRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGDDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 13113 - protein, 119 aa, Escherichia coli DEC7B; identical to SEQ ID NO: 5985

SEQ ID NO: 13114 - protein, 258 aa, Escherichia coli DEC7B; identical to SEQ ID NO: 6001

SEQ ID NO: 13115 - protein, 728 aa, Escherichia coli DEC7B; identical to SEQ ID NO: 12987

SEQ ID NO: 13116 - protein, 241 aa, Escherichia coli DEC7C; identical to SEQ ID NO: 6143

SEQ ID NO: 13117 - protein, 863 aa, Escherichia coli DEC7C; identical to SEQ ID NO: 8466

SEQ ID NO: 13118 - protein, 729 aa, Escherichia coli DEC7C; identical to SEQ ID NO: 12984

SEQ ID NO: 13119 - protein, 266 aa, Escherichia coli DEC7C; identical to SEQ ID NO: 5772

SEQ ID NO: 13120 - protein, 161 aa, Escherichia coli DEC7C; identical to SEQ ID NO: 5769

SEQ ID NO: 13121 - protein, 784 aa, Escherichia coli DEC7C; identical to SEQ ID NO: 12980

SEQ ID NO: 13122 - protein, 368 aa, Escherichia coli DEC7C; identical to SEQ ID NO: 7728

SEQ ID NO: 13123 - protein, 170 aa, Escherichia coli DEC7C [sequence omitted]

SEQ ID NO: 13124 - protein, 765 aa, Escherichia coli DEC7C; identical to SEQ ID NO: 12982

SEQ ID NO: 13125 - protein, 246 aa, Escherichia coli DEC7C; identical to SEQ ID NO: 6342

SEQ ID NO: 13126 - protein, 351 aa, Escherichia coli DEC7C; identical to SEQ ID NO: 5767

SEQ ID NO: 13127 - protein, 230 aa, Escherichia coli DEC7C; identical to SEQ ID NO: 6294

SEQ ID NO: 13128 - protein, 820 aa, Escherichia coli DEC7C; identical to SEQ ID NO: 12991

SEQ ID NO: 13129 - protein, 746 aa, Escherichia coli DEC7C; identical to SEQ ID NO: 7355

SEQ ID NO: 13130 - protein, 193 aa, Escherichia coli DEC7C; identical to SEQ ID NO: 6300

SEQ ID NO: 13131 - protein, 191 aa, Escherichia coli DEC7C; identical to SEQ ID NO: 5748

SEQ ID NO: 13132 - protein, 232 aa, Escherichia coli DEC7C; identical to SEQ ID NO: 5747

SEQ ID NO: 13133 - protein, 430 aa, Escherichia coli DEC7C; identical to SEQ ID NO: 5758

SEQ ID NO: 13134 - protein, 331 aa, Escherichia coli DEC7C; identical to SEQ ID NO: 12995

SEQ ID NO: 13135 - protein, 203 aa, Escherichia coli DEC7C; identical to SEQ ID NO: 6414

SEQ ID NO: 13136 - protein, 361 aa, Escherichia coli DEC7C; identical to SEQ ID NO: 7868

SEQ ID NO: 13137 - protein, 224 aa, Escherichia coli DEC7C; identical to SEQ ID NO: 7869

SEQ ID NO: 13138 - protein, 851 aa, Escherichia coli DEC7C; identical to SEQ ID NO: 13000

SEQ ID NO: 13139 - protein, 130 aa, Escherichia coli DEC7C
MPVDRETLFELSIASVPSGKVENQSVKVAIRSVFKLFWRPEGLPGDPLEAYQQLRWTWNSQGVQLTNPTPYYINLIQVSVNGKALSNAGVVPPKSQRQTSWCQAIAPCHVAWRAINDYGGLSAKKEQNLP

SEQ ID NO: 13140 - protein, 243 aa, Escherichia coli DEC7C; identical to SEQ ID NO: 6463

SEQ ID NO: 13141 - protein, 816 aa, Escherichia coli DEC7C; identical to SEQ ID NO: 13008

SEQ ID NO: 13142 - protein, 760 aa, Escherichia coli DEC7C; identical to SEQ ID NO: 12996

SEQ ID NO: 13143 - protein, 203 aa, Escherichia coli DEC7C; identical to SEQ ID NO: 6347

SEQ ID NO: 13144 - protein, 565 aa, Escherichia coli DEC7C
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPHQLNTLRTTSIVPVDLNSLMFKMEKILARASKAAGDNAMANQYETLANARQKGIEKYMWNDQQGWYADYDLKSYKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 13145 - protein, 207 aa, Escherichia coli DEC7C; identical to SEQ ID NO: 13010

SEQ ID NO: 13146 - protein, 729 aa, Escherichia coli DEC7C; identical to SEQ ID NO: 13004

SEQ ID NO: 13147 - protein, 213 aa, Escherichia coli DEC7C; identical to SEQ ID NO: 5744

SEQ ID NO: 13148 - protein, 360 aa, Escherichia coli DEC7C; identical to SEQ ID NO: 8317

SEQ ID NO: 13149 - protein, 539 aa, Escherichia coli DEC7C; identical to SEQ ID NO: 6525

SEQ ID NO: 13150 - protein, 700 aa, Escherichia coli DEC7C; identical to SEQ ID NO: 13012

SEQ ID NO: 13151 - protein, 871 aa, Escherichia coli DEC7C
MHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSATNGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEASPGTLLNQQTAICR

SEQ ID NO: 13152 - protein, 236 aa, Escherichia coli DEC7C; identical to SEQ ID NO: 6472

SEQ ID NO: 13153 - protein, 774 aa, Escherichia coli DEC7C; identical to SEQ ID NO: 13044

SEQ ID NO: 13154 - protein, 111 aa, Escherichia coli DEC7C; identical to SEQ ID NO: 7885

SEQ ID NO: 13155 - protein, 118 aa, Escherichia coli DEC7C [sequence omitted]

SEQ ID NO: 13156 - protein, 673 aa, Escherichia coli DEC7C; identical to SEQ ID NO: 6170

SEQ ID NO: 13157 - protein, 826 aa, Escherichia coli DEC7C
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 13158 - protein, 224 aa, Escherichia coli DEC7C; identical to SEQ ID NO: 6302

SEQ ID NO: 13159 - protein, 222 aa, Escherichia coli DEC7C
MGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSFNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 13160 - protein, 274 aa, Escherichia coli DEC7C; identical to SEQ ID NO: 6489

SEQ ID NO: 13161 - protein, 250 aa, Escherichia coli DEC7C; identical to SEQ ID NO: 6317

SEQ ID NO: 13162 - protein, 881 aa, Escherichia coli DEC7C; identical to SEQ ID NO: 13025

SEQ ID NO: 13163 - protein, 162 aa, Escherichia coli DEC7C; identical to SEQ ID NO: 5896

SEQ ID NO: 13164 - protein, 367 aa, Escherichia coli DEC7C; identical to SEQ ID NO: 5784

SEQ ID NO: 13165 - protein, 200 aa, Escherichia coli DEC7C; identical to SEQ ID NO: 6311

SEQ ID NO: 13166 - protein, 518 aa, Escherichia coli DEC7C; identical to SEQ ID NO: 6358

SEQ ID NO: 13167 - protein, 359 aa, Escherichia coli DEC7C; identical to SEQ ID NO: 5847

SEQ ID NO: 13168 - protein, 615 aa, Escherichia coli DEC7C; identical to SEQ ID NO: 10017

SEQ ID NO: 13169 - protein, 432 aa, Escherichia coli DEC7C; identical to SEQ ID NO: 5727

SEQ ID NO: 13170 - protein, 834 aa, Escherichia coli DEC7C; identical to SEQ ID NO: 13027

SEQ ID NO: 13171 - protein, 249 aa, Escherichia coli DEC7C; identical to SEQ ID NO: 6450

SEQ ID NO: 13172 - protein, 231 aa, Escherichia coli DEC7C; identical to SEQ ID NO: 13029

SEQ ID NO: 13173 - protein, 429 aa, Escherichia coli DEC7C; identical to SEQ ID NO: 13030

SEQ ID NO: 13174 - protein, 678 aa, Escherichia coli DEC7C; identical to SEQ ID NO: 13031

SEQ ID NO: 13175 - protein, 650 aa, Escherichia coli DEC7C
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYHSLSKEKYTRYRQEQQQRIDGKSKALVGSEDLPVLDENTFNSHAPAPSSR

SEQ ID NO: 13176 - protein, 903 aa, Escherichia coli DEC7C; identical to SEQ ID NO: 13035

SEQ ID NO: 13177 - protein, 386 aa, Escherichia coli DEC7C; identical to SEQ ID NO: 13036

SEQ ID NO: 13178 - protein, 370 aa, Escherichia coli DEC7C; identical to SEQ ID NO: 13037

SEQ ID NO: 13179 - protein, 45 aa, Escherichia coli DEC7C; identical to SEQ ID NO: 10025

SEQ ID NO: 13180 - protein, 243 aa, Escherichia coli DEC7C; identical to SEQ ID NO: 13039

SEQ ID NO: 13181 - protein, 208 aa, Escherichia coli DEC7C; identical to SEQ ID NO: 5717

SEQ ID NO: 13182 - protein, 614 aa, Escherichia coli DEC7C; identical to SEQ ID NO: 7971

SEQ ID NO: 13183 - protein, 446 aa, Escherichia coli DEC7C; identical to SEQ ID NO: 6459

SEQ ID NO: 13184 - protein, 237 aa, Escherichia coli DEC7C; identical to SEQ ID NO: 13043

SEQ ID NO: 13185 - protein, 478 aa, Escherichia coli DEC7C
MTRIKINARRIFSLLIPFFFFTSVHAEQTAAPPKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 13186 - protein, 258 aa, Escherichia coli DEC7C; identical to SEQ ID NO: 6001

SEQ ID NO: 13187 - protein, 121 aa, Escherichia coli DEC7C
MDAILSVQGASAPVKKKSFFSKFTRLNMLRLARAVIPAAVMMMFFPQLAMAAGSSGQDLMQSGNSTVKATFGKDSSVVKWVVLAEVLVGAVMYMMTKNVKFLAGFAIISVFIAVGMAVVGL

SEQ ID NO: 13188 - protein, 119 aa, Escherichia coli DEC7C
MNLSLFKGGRPASVKNRAWHYCQMAWRGVCSQKALSRLAALSPLLLLGMGQMAHATDLLAGGKDDVKATFGADSFVIMCIYIAEIVIGVATYIRTKNLLILLGLVVVIVFTTVGLTFVS

SEQ ID NO: 13189 - protein, 119 aa, Escherichia coli DEC7C; identical to SEQ ID NO: 5985

SEQ ID NO: 13190 - protein, 218 aa, Escherichia coli DEC7C; identical to SEQ ID NO: 12977

SEQ ID NO: 13191 - protein, 73 aa, Escherichia coli DEC7C
MAGKREMVIITFKSGETFQVEVPGSQHIDSQKKAIERMKDTLRITYLTETKIDKLCVWNNKTPNSIAAISMKN

SEQ ID NO: 13192 - protein, 1024 aa, Escherichia coli DEC7C
MTTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNILGGGAENIGDNLGKAGGILSTFQNFLGTALSSMKIDELIKKQKSGGNVSSSEMAEASIELINQLVDTVASLNNNVNSFSQQLNTLGSVLSNTKHLNGVGNKLQNLPNLDNIGAGLDTVSGILSAISASFILSNADADTRTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGAVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDLIEGNDGNDRLYGDKGNDTLSGGNGDDQLYGGDGNDKLIGGAGNNYLNGGDGDDELQVQGNSLAKNVLFGGKGNDKLYGSEGADLLDGGEGDDLLKGGYGNDIYRYLSGYGHHIIDDDGGKEDKLSLADIDFRDVAFKREGNDLIMYKAEGNVLSIGHKNGITFRNWFEKESGDISNHQIEQIFDKSGRIITPDSLKKALEYQQRNNKASYVYGNDALAYGSQGDLNPLINEISKIISAAGSFDVKEERTAASLLQLSGNASDFSYGRNSITLTTSA

SEQ ID NO: 13193 - protein, 774 aa, Escherichia coli DEC7D; identical to SEQ ID NO: 13044

SEQ ID NO: 13194 - protein, 368 aa, Escherichia coli DEC7D; identical to SEQ ID NO: 7728

SEQ ID NO: 13195 - protein, 241 aa, Escherichia coli DEC7D; identical to SEQ ID NO: 6143

SEQ ID NO: 13196 - protein, 863 aa, Escherichia coli DEC7D; identical to SEQ ID NO: 8466

SEQ ID NO: 13197 - protein, 784 aa, Escherichia coli DEC7D; identical to SEQ ID NO: 12980

SEQ ID NO: 13198 - protein, 170 aa, Escherichia coli DEC7D [sequence omitted]

SEQ ID NO: 13199 - protein, 765 aa, Escherichia coli DEC7D; identical to SEQ ID NO: 12982

SEQ ID NO: 13200 - protein, 246 aa, Escherichia coli DEC7D; identical to SEQ ID NO: 6342

SEQ ID NO: 13201 - protein, 703 aa, Escherichia coli DEC7D
MSVYAQAAVEPKEDTITVTAAPAPQESAWGPAATIAAKHSATATKTDTPIEKTPQSISVVTNEEMQMHQFQSVKEALGYTPGVTVSSRGASNTYDFVIIRGFSSVGLNQNNYLDGLKLQGNFYNDAVIDPYMLERVELMRGPTSVLYGKSNPGGIISMVSKRPTTEPLKEIQFKMGTDNLFQTGFDFSDALDDNGEFSYRLTGLARSTNEQQKNSESQRYTIAPSFSWRPDDKTNFTFLSYFQNEPETGYYGWLPKEGTVEPLPNGKRLPTDFNEGASNNTYSRNQKMVGYSFEHGFNDTFTVRQNLRFSEMKTSQKSVYGTGIANDGHTLNRGTVVDNERLQNFSVDTQLESKFATGEVEHTLLTGVDFMRMRNDINASFGSAPSIDLYNKYHPEYFAFGNAEPYQMNESKQTGIYVQDQAEWNKWVFTLGGRYDWSKQATTVRENSYTPTEGYIERNDHQFTWRGGVNYLFDNGISPYFSYSQSFEPSAFDLWSNPRVSYKPSKGEQYEAGVKYVPNDMPVVVTGAVYQLTKTNNLTADPTNPLAQVPAGEIRARGVELEAKAALNANINLTASYTYTDAEYTKDTNLKGKTPEQVPEHMASLWGDYTFNEGPLSGLTLGTGGRFIGSSYGDPANTFKVGSAAVMDAVVKYDLARFGMAGSSLAVNVNNLLDREYVASCFQTYGCFWGAERQVVATATFRF

SEQ ID NO: 13202 - protein, 266 aa, Escherichia coli DEC7D; identical to SEQ ID NO: 5772

SEQ ID NO: 13203 - protein, 161 aa, Escherichia coli DEC7D; identical to SEQ ID NO: 5769

SEQ ID NO: 13204 - protein, 230 aa, Escherichia coli DEC7D; identical to SEQ ID NO: 6294

SEQ ID NO: 13205 - protein, 780 aa, Escherichia coli DEC7D
MKIPTTTDIPQRYTWCLAGICYSSLAILPSFLSYAESYFNPAFLLENGTSVADLSRFERGNHQPARVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSEFSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYATLGVGYNYDRDQHDVNWQLSGGVVGHENGITLSQPFGDTNVLIKAPGAGGVRIENQTGILTDWRGYAVMPYATVYRYNRIALDTNTMGNSIDVEKILAALCRRKARWFVPILIPA

SEQ ID NO: 13206 - protein, 746 aa, Escherichia coli DEC7D; identical to SEQ ID NO: 7355

SEQ ID NO: 13207 - protein, 193 aa, Escherichia coli DEC7D; identical to SEQ ID NO: 6300

SEQ ID NO: 13208 - protein, 243 aa, Escherichia coli DEC7D; identical to SEQ ID NO: 6463

SEQ ID NO: 13209 - protein, 816 aa, Escherichia coli DEC7D; identical to SEQ ID NO: 13008

SEQ ID NO: 13210 - protein, 430 aa, Escherichia coli DEC7D; identical to SEQ ID NO: 5758

SEQ ID NO: 13211 - protein, 331 aa, Escherichia coli DEC7D; identical to SEQ ID NO: 12995

SEQ ID NO: 13212 - protein, 760 aa, Escherichia coli DEC7D; identical to SEQ ID NO: 12996

SEQ ID NO: 13213 - protein, 203 aa, Escherichia coli DEC7D; identical to SEQ ID NO: 6414

SEQ ID NO: 13214 - protein, 361 aa, Escherichia coli DEC7D; identical to SEQ ID NO: 7868

SEQ ID NO: 13215 - protein, 224 aa, Escherichia coli DEC7D; identical to SEQ ID NO: 7869

SEQ ID NO: 13216 - protein, 591 aa, Escherichia coli DEC7D
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVCDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKITPG

SEQ ID NO: 13217 - protein, 226 aa, Escherichia coli DEC7D
MIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAIRSVFKLFWRPEGLPGDPLEAYQQLRWTWNSQGVQLTNPTPYYINLIQVSVNGKALSNAGVVPPKSQRQTSWCQAIAPCHVAWRAINDYGGLSAKKEQNLP

SEQ ID NO: 13218 - protein, 191 aa, Escherichia coli DEC7D; identical to SEQ ID NO: 5748

SEQ ID NO: 13219 - protein, 232 aa, Escherichia coli DEC7D; identical to SEQ ID NO: 5747

SEQ ID NO: 13220 - protein, 729 aa, Escherichia coli DEC7D; identical to SEQ ID NO: 13004

SEQ ID NO: 13221 - protein, 213 aa, Escherichia coli DEC7D; identical to SEQ ID NO: 5744

SEQ ID NO: 13222 - protein, 700 aa, Escherichia coli DEC7D; identical to SEQ ID NO: 13012

SEQ ID NO: 13223 - protein, 351 aa, Escherichia coli DEC7D; identical to SEQ ID NO: 5767

SEQ ID NO: 13224 - protein, 360 aa, Escherichia coli DEC7D; identical to SEQ ID NO: 8317

SEQ ID NO: 13225 - protein, 203 aa, Escherichia coli DEC7D; identical to SEQ ID NO: 6347

SEQ ID NO: 13226 - protein, 565 aa, Escherichia coli DEC7D; identical to SEQ ID NO: 13144

SEQ ID NO: 13227 - protein, 207 aa, Escherichia coli DEC7D; identical to SEQ ID NO: 13010

SEQ ID NO: 13228 - protein, 539 aa, Escherichia coli DEC7D; identical to SEQ ID NO: 6525

SEQ ID NO: 13229 - protein, 871 aa, Escherichia coli DEC7D; identical to SEQ ID NO: 13151

SEQ ID NO: 13230 - protein, 236 aa, Escherichia coli DEC7D; identical to SEQ ID NO: 6472

SEQ ID NO: 13231 - protein, 111 aa, Escherichia coli DEC7D; identical to SEQ ID NO: 7885

SEQ ID NO: 13232 - protein, 118 aa, Escherichia coli DEC7D [sequence omitted]

SEQ ID NO: 13233 - protein, 673 aa, Escherichia coli DEC7D; identical to SEQ ID NO: 6170

SEQ ID NO: 13234 - protein, 826 aa, Escherichia coli DEC7D; identical to SEQ ID NO: 13157

SEQ ID NO: 13235 - protein, 224 aa, Escherichia coli DEC7D; identical to SEQ ID NO: 6302

SEQ ID NO: 13236 - protein, 222 aa, Escherichia coli DEC7D; identical to SEQ ID NO: 13159

SEQ ID NO: 13237 - protein, 162 aa, Escherichia coli DEC7D; identical to SEQ ID NO: 5896

SEQ ID NO: 13238 - protein, 367 aa, Escherichia coli DEC7D; identical to SEQ ID NO: 5784

SEQ ID NO: 13239 - protein, 200 aa, Escherichia coli DEC7D; identical to SEQ ID NO: 6311

SEQ ID NO: 13240 - protein, 274 aa, Escherichia coli DEC7D; identical to SEQ ID NO: 6489

SEQ ID NO: 13241 - protein, 250 aa, Escherichia coli DEC7D; identical to SEQ ID NO: 6317

SEQ ID NO: 13242 - protein, 881 aa, Escherichia coli DEC7D; identical to SEQ ID NO: 13025

SEQ ID NO: 13243 - protein, 518 aa, Escherichia coli DEC7D; identical to SEQ ID NO: 6358

SEQ ID NO: 13244 - protein, 432 aa, Escherichia coli DEC7D; identical to SEQ ID NO: 5727

SEQ ID NO: 13245 - protein, 120 aa, Escherichia coli DEC7D; identical to SEQ ID NO: 12975

SEQ ID NO: 13246 - protein, 812 aa, Escherichia coli DEC7D
MKKYVTTKSVQPVAFRLTTLSLVMSAVLGSASVIAGEKLDMSFIQGGGGVNPEVWAALNGSYAPGRYLVDLSLNGKEAGKQILDVTPQDSNELCLTEAWLTKAGVYVSADYFREGYDATRQCYVLTKAPSVKVDFDVSTQSLALSIPQKGLVKMPENVDWDYGTSAFRVNYNANANTGRNNTSAFGSADLKANIGHWVVSSSATASGGDSGDNSTTINMFTATRAIRALSADLAVGKTSTGDSLLGSTGTYGVSLSRNNSMKPGNLGYTPVFSGIANGPSRVTLTQNGRLLHSEMVPAGPFSITDVPLYTSGDVTMKITGEDGREQVQNFPLSVMAGQLSPGQHEFSVAAGLPDDDSDLKGGVFAASYGYGLDGLTLRAGGVFNQDWQGASAGVVAGLGYLGAVSADGAYATAKYRDGSHSGNKVQLSWSKQLETTNTGLRVSWSRQSEEYEGMSSFDPTELWSQSNHGRRTKDEWNAGISQPVGGLFSLSVSGWQRSYYPASMTGSYRYSDDNGKETGITGSLSTQIKGVSLNLGWSGSRNSRGENNWSASASVSVPFTLFDRRYSSSASVSTSKGGGTGFSTGVSGSLNDRFSYGLGGGRDGDGGTSSYLNASYSGDRAYLNGVLNHSQSGGTSGSVSVSGSVLAVPAAKDIMFSRTTGDTVAVVNVKDTPGVKVTSGDGQTDSDGNLVVPLNSYDWNTVTIDAGTLPLSTELTNTSQKVVPTDKAVVWMPFDALKVKRYLLQVKQRDGEFVPGGTWARDSKNTPLGFVANNGVLMINTVDAPGDITLGQCRIPAARLQDTEKLQEITCE

SEQ ID NO: 13247 - protein, 258 aa, Escherichia coli DEC7D; identical to SEQ ID NO: 6001

SEQ ID NO: 13248 - protein, 121 aa, Escherichia coli DEC7D; identical to SEQ ID NO: 13187

SEQ ID NO: 13249 - protein, 359 aa, Escherichia coli DEC7D; identical to SEQ ID NO: 5847

SEQ ID NO: 13250 - protein, 686 aa, Escherichia coli DEC7D; identical to SEQ ID NO: 6453

SEQ ID NO: 13251 - protein, 834 aa, Escherichia coli DEC7D; identical to SEQ ID NO: 13027

SEQ ID NO: 13252 - protein, 249 aa, Escherichia coli DEC7D; identical to SEQ ID NO: 6450

SEQ ID NO: 13253 - protein, 231 aa, Escherichia coli DEC7D; identical to SEQ ID NO: 13029

SEQ ID NO: 13254 - protein, 429 aa, Escherichia coli DEC7D; identical to SEQ ID NO: 13030

SEQ ID NO: 13255 - protein, 678 aa, Escherichia coli DEC7D; identical to SEQ ID NO: 13031

SEQ ID NO: 13256 - protein, 650 aa, Escherichia coli DEC7D; identical to SEQ ID NO: 13175

SEQ ID NO: 13257 - protein, 903 aa, Escherichia coli DEC7D; identical to SEQ ID NO: 13035

SEQ ID NO: 13258 - protein, 386 aa, Escherichia coli DEC7D; identical to SEQ ID NO: 13036

SEQ ID NO: 13259 - protein, 45 aa, Escherichia coli DEC7D; identical to SEQ ID NO: 10025

SEQ ID NO: 13260 - protein, 243 aa, Escherichia coli DEC7D; identical to SEQ ID NO: 13039

SEQ ID NO: 13261 - protein, 370 aa, Escherichia coli DEC7D; identical to SEQ ID NO: 13037

SEQ ID NO: 13262 - protein, 208 aa, Escherichia coli DEC7D; identical to SEQ ID NO: 5717

SEQ ID NO: 13263 - protein, 614 aa, Escherichia coli DEC7D; identical to SEQ ID NO: 7971

SEQ ID NO: 13264 - protein, 446 aa, Escherichia coli DEC7D; identical to SEQ ID NO: 6459

SEQ ID NO: 13265 - protein, 237 aa, Escherichia coli DEC7D; identical to SEQ ID NO: 13043

SEQ ID NO: 13266 - protein, 119 aa, Escherichia coli DEC7D
MNLSLFKGGRPASVKNRAWHYCQMAWRGVCNQKALSRLAALSPLLLLGMGQMAHATDLLAGGKDDVKATFGADSFVIMCIYIAEIVIGVATYIRTKNLLILLGLVVVIVFTTVGLTFVS

SEQ ID NO: 13267 - protein, 119 aa, Escherichia coli DEC7D; identical to SEQ ID NO: 5985

SEQ ID NO: 13268 - protein, 784 aa, Escherichia coli DEC7E; identical to SEQ ID NO: 12980

SEQ ID NO: 13269 - protein, 170 aa, Escherichia coli DEC7E [sequence omitted]

SEQ ID NO: 13270 - protein, 339 aa, Escherichia coli DEC7E
MQFHINSPDINNEKAVLLARDETLGNCLNLTEIIPQTSVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDGFVE

SEQ ID NO: 13271 - protein, 246 aa, Escherichia coli DEC7E; identical to SEQ ID NO: 6342

SEQ ID NO: 13272 - protein, 703 aa, Escherichia coli DEC7E; identical to SEQ ID NO: 13201

SEQ ID NO: 13273 - protein, 266 aa, Escherichia coli DEC7E; identical to SEQ ID NO: 5772

SEQ ID NO: 13274 - protein, 161 aa, Escherichia coli DEC7E; identical to SEQ ID NO: 5769

SEQ ID NO: 13275 - protein, 230 aa, Escherichia coli DEC7E; identical to SEQ ID NO: 6294

SEQ ID NO: 13276 - protein, 820 aa, Escherichia coli DEC7E; identical to SEQ ID NO: 12991

SEQ ID NO: 13277 - protein, 746 aa, Escherichia coli DEC7E; identical to SEQ ID NO: 7355

SEQ ID NO: 13278 - protein, 193 aa, Escherichia coli DEC7E; identical to SEQ ID NO: 6300

SEQ ID NO: 13279 - protein, 351 aa, Escherichia coli DEC7E; identical to SEQ ID NO: 5767

SEQ ID NO: 13280 - protein, 331 aa, Escherichia coli DEC7E; identical to SEQ ID NO: 12995

SEQ ID NO: 13281 - protein, 760 aa, Escherichia coli DEC7E; identical to SEQ ID NO: 12996

SEQ ID NO: 13282 - protein, 203 aa, Escherichia coli DEC7E; identical to SEQ ID NO: 6414

SEQ ID NO: 13283 - protein, 361 aa, Escherichia coli DEC7E; identical to SEQ ID NO: 7868

SEQ ID NO: 13284 - protein, 224 aa, Escherichia coli DEC7E; identical to SEQ ID NO: 7869

SEQ ID NO: 13285 - protein, 591 aa, Escherichia coli DEC7E; identical to SEQ ID NO: 13216

SEQ ID NO: 13286 - protein, 128 aa, Escherichia coli DEC7E
MDRETLFELSIASVPSGKVENQSVKVAIRSVFKLFWRPEGLPGDPLEAYQQLRWTWNSQGVQLTNPTPYYINLIQVSVNGKALSNAGVVPPKSQRQTSWCQAIAPCHVAWRAINDYGGLSAKKEQNLP

SEQ ID NO: 13287 - protein, 729 aa, Escherichia coli DEC7E; identical to SEQ ID NO: 13004

SEQ ID NO: 13288 - protein, 213 aa, Escherichia coli DEC7E; identical to SEQ ID NO: 5744

SEQ ID NO: 13289 - protein, 565 aa, Escherichia coli DEC7E; identical to SEQ ID NO: 13144

SEQ ID NO: 13290 - protein, 207 aa, Escherichia coli DEC7E; identical to SEQ ID NO: 13010

SEQ ID NO: 13291 - protein, 191 aa, Escherichia coli DEC7E; identical to SEQ ID NO: 5748

SEQ ID NO: 13292 - protein, 232 aa, Escherichia coli DEC7E; identical to SEQ ID NO: 5747

SEQ ID NO: 13293 - protein, 360 aa, Escherichia coli DEC7E; identical to SEQ ID NO: 8317

SEQ ID NO: 13294 - protein, 551 aa, Escherichia coli DEC7E; identical to SEQ ID NO: 5742

SEQ ID NO: 13295 - protein, 646 aa, Escherichia coli DEC7E
MRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 13296 - protein, 203 aa, Escherichia coli DEC7E; identical to SEQ ID NO: 6347

SEQ ID NO: 13297 - protein, 243 aa, Escherichia coli DEC7E; identical to SEQ ID NO: 6463

SEQ ID NO: 13298 - protein, 816 aa, Escherichia coli DEC7E; identical to SEQ ID NO: 13008

SEQ ID NO: 13299 - protein, 430 aa, Escherichia coli DEC7E; identical to SEQ ID NO: 5758

SEQ ID NO: 13300 - protein, 774 aa, Escherichia coli DEC7E; identical to SEQ ID NO: 13044

SEQ ID NO: 13301 - protein, 871 aa, Escherichia coli DEC7E; identical to SEQ ID NO: 13151

SEQ ID NO: 13302 - protein, 113 aa, Escherichia coli DEC7E; identical to SEQ ID NO: 8972

SEQ ID NO: 13303 - protein, 111 aa, Escherichia coli DEC7E; identical to SEQ ID NO: 7885

SEQ ID NO: 13304 - protein, 118 aa, Escherichia coli DEC7E [sequence omitted]

SEQ ID NO: 13305 - protein, 673 aa, Escherichia coli DEC7E; identical to SEQ ID NO: 6170

SEQ ID NO: 13306 - protein, 218 aa, Escherichia coli DEC7E; identical to SEQ ID NO: 12977

SEQ ID NO: 13307 - protein, 826 aa, Escherichia coli DEC7E; identical to SEQ ID NO: 13157

SEQ ID NO: 13308 - protein, 224 aa, Escherichia coli DEC7E; identical to SEQ ID NO: 6302

SEQ ID NO: 13309 - protein, 341 aa, Escherichia coli DEC7E; identical to SEQ ID NO: 13017

SEQ ID NO: 13310 - protein, 162 aa, Escherichia coli DEC7E; identical to SEQ ID NO: 5896

SEQ ID NO: 13311 - protein, 367 aa, Escherichia coli DEC7E; identical to SEQ ID NO: 5784

SEQ ID NO: 13312 - protein, 200 aa, Escherichia coli DEC7E; identical to SEQ ID NO: 6311

SEQ ID NO: 13313 - protein, 274 aa, Escherichia coli DEC7E; identical to SEQ ID NO: 6489

SEQ ID NO: 13314 - protein, 250 aa, Escherichia coli DEC7E; identical to SEQ ID NO: 6317

SEQ ID NO: 13315 - protein, 881 aa, Escherichia coli DEC7E; identical to SEQ ID NO: 13025

SEQ ID NO: 13316 - protein, 518 aa, Escherichia coli DEC7E; identical to SEQ ID NO: 6358

SEQ ID NO: 13317 - protein, 432 aa, Escherichia coli DEC7E; identical to SEQ ID NO: 5727

SEQ ID NO: 13318 - protein, 359 aa, Escherichia coli DEC7E; identical to SEQ ID NO: 5847

SEQ ID NO: 13319 - protein, 686 aa, Escherichia coli DEC7E; identical to SEQ ID NO: 6453

SEQ ID NO: 13320 - protein, 562 aa, Escherichia coli DEC7E
MLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGSSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 13321 - protein, 249 aa, Escherichia coli DEC7E; identical to SEQ ID NO: 6450

SEQ ID NO: 13322 - protein, 199 aa, Escherichia coli DEC7E
MIYDASRKEAALPVANKGAETPYLLQSWVDNIDGTSRAPFIITPPLFRLEAGDDSSLRIIKTADNLPENKESLFYINVRAIPAKKKSDNVNANELTLVFKTRIKMFYRPAHLKGRVNDAWKSLEFKRSDHSLNIYNPTEYYVVFAGLAVDKTDLTSKIEYIAPGEHKQLPLPASGGKNVKWAAINDYGGSSGTETRPLQ

SEQ ID NO: 13323 - protein, 312 aa, Escherichia coli DEC7E
MDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYSGLLGSEDYYALGIGIGGTLGRLAP

SEQ ID NO: 13324 - protein, 678 aa, Escherichia coli DEC7E; identical to SEQ ID NO: 13031

SEQ ID NO: 13325 - protein, 654 aa, Escherichia coli DEC7E; identical to SEQ ID NO: 13034

SEQ ID NO: 13326 - protein, 903 aa, Escherichia coli DEC7E; identical to SEQ ID NO: 13035

SEQ ID NO: 13327 - protein, 386 aa, Escherichia coli DEC7E; identical to SEQ ID NO: 13036

SEQ ID NO: 13328 - protein, 370 aa, Escherichia coli DEC7E; identical to SEQ ID NO: 13037

SEQ ID NO: 13329 - protein, 243 aa, Escherichia coli DEC7E; identical to SEQ ID NO: 13039

SEQ ID NO: 13330 - protein, 208 aa, Escherichia coli DEC7E; identical to SEQ ID NO: 5717

SEQ ID NO: 13331 - protein, 45 aa, Escherichia coli DEC7E; identical to SEQ ID NO: 10025

SEQ ID NO: 13332 - protein, 478 aa, Escherichia coli DEC7E; identical to SEQ ID NO: 13185

SEQ ID NO: 13333 - protein, 446 aa, Escherichia coli DEC7E; identical to SEQ ID NO: 6459

SEQ ID NO: 13334 - protein, 237 aa, Escherichia coli DEC7E; identical to SEQ ID NO: 13043

SEQ ID NO: 13335 - protein, 368 aa, Escherichia coli DEC7E; identical to SEQ ID NO: 7728

SEQ ID NO: 13336 - protein, 241 aa, Escherichia coli DEC7E; identical to SEQ ID NO: 6143

SEQ ID NO: 13337 - protein, 856 aa, Escherichia coli DEC7E; identical to SEQ ID NO: 9540

SEQ ID NO: 13338 - protein, 839 aa, Escherichia coli DEC7E
MTTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNILGGGAENIGDNLGKAGGILSTFQNFLGTALSSMKIDELIKKQKSGGNVSSSEMAEASIELINQLVDTVASLNNNVNSFSQQLNTLGSVLSNTKHLNGVGNKLQNLPNLDNIGAGLDTVSGILSAISASFILSNADADTRTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGAVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDLIEGNDGNDRLYGDKGNDTLIGGNGDDQLYGGDGNDKLIGGAGNNYLNGGDGDDELQVQGNSLAKNVLFGGKGNDKLYGSEGADLLDGGGGG

SEQ ID NO: 13339 - protein, 119 aa, Escherichia coli DEC7E; identical to SEQ ID NO: 5985

SEQ ID NO: 13340 - protein, 784 aa, Escherichia coli DEC8A; identical to SEQ ID NO: 7852

SEQ ID NO: 13341 - protein, 170 aa, Escherichia coli DEC8A [sequence omitted]

SEQ ID NO: 13342 - protein, 765 aa, Escherichia coli DEC8A; identical to SEQ ID NO: 7854

SEQ ID NO: 13343 - protein, 230 aa, Escherichia coli DEC8A; identical to SEQ ID NO: 7855

SEQ ID NO: 13344 - protein, 747 aa, Escherichia coli DEC8A; identical to SEQ ID NO: 6343

SEQ ID NO: 13345 - protein, 266 aa, Escherichia coli DEC8A; identical to SEQ ID NO: 5772

SEQ ID NO: 13346 - protein, 161 aa, Escherichia coli DEC8A; identical to SEQ ID NO: 5769

SEQ ID NO: 13347 - protein, 221 aa, Escherichia coli DEC8A; identical to SEQ ID NO: 7859

SEQ ID NO: 13348 - protein, 351 aa, Escherichia coli DEC8A; identical to SEQ ID NO: 6367

SEQ ID NO: 13349 - protein, 89 aa, Escherichia coli DEC8A; identical to SEQ ID NO: 6232

SEQ ID NO: 13350 - protein, 230 aa, Escherichia coli DEC8A; identical to SEQ ID NO: 7861

SEQ ID NO: 13351 - protein, 869 aa, Escherichia coli DEC8A; identical to SEQ ID NO: 7862

SEQ ID NO: 13352 - protein, 746 aa, Escherichia coli DEC8A; identical to SEQ ID NO: 6296

SEQ ID NO: 13353 - protein, 193 aa, Escherichia coli DEC8A; identical to SEQ ID NO: 7864

SEQ ID NO: 13354 - protein, 243 aa, Escherichia coli DEC8A; identical to SEQ ID NO: 6463

SEQ ID NO: 13355 - protein, 816 aa, Escherichia coli DEC8A; identical to SEQ ID NO: 6462

SEQ ID NO: 13356 - protein, 430 aa, Escherichia coli DEC8A; identical to SEQ ID NO: 5758

SEQ ID NO: 13357 - protein, 331 aa, Escherichia coli DEC8A; identical to SEQ ID NO: 6456

SEQ ID NO: 13358 - protein, 760 aa, Escherichia coli DEC8A; identical to SEQ ID NO: 7873

SEQ ID NO: 13359 - protein, 203 aa, Escherichia coli DEC8A; identical to SEQ ID NO: 6414

SEQ ID NO: 13360 - protein, 361 aa, Escherichia coli DEC8A; identical to SEQ ID NO: 7868

SEQ ID NO: 13361 - protein, 224 aa, Escherichia coli DEC8A; identical to SEQ ID NO: 7869

SEQ ID NO: 13362 - protein, 591 aa, Escherichia coli DEC8A; identical to SEQ ID NO: 7870

SEQ ID NO: 13363 - protein, 226 aa, Escherichia coli DEC8A; identical to SEQ ID NO: 7934

SEQ ID NO: 13364 - protein, 191 aa, Escherichia coli DEC8A; identical to SEQ ID NO: 5748

SEQ ID NO: 13365 - protein, 232 aa, Escherichia coli DEC8A; identical to SEQ ID NO: 5747

SEQ ID NO: 13366 - protein, 729 aa, Escherichia coli DEC8A; identical to SEQ ID NO: 7878

SEQ ID NO: 13367 - protein, 213 aa, Escherichia coli DEC8A; identical to SEQ ID NO: 5744

SEQ ID NO: 13368 - protein, 203 aa, Escherichia coli DEC8A
MKLRWFAFLIVLLAGCSSKHDYTNPPWNAKVPVQRAMQWMPISQKAGAAWGVDPQLITAIIAIESGGNPNAVSKSNAIGLMQLKASTSGRDVYRRMGWSGEPTTSELKNPERNISMGAAYLNILETGPLAGIEDPKVLQYALVVSYANGASALLRTFSSDRKKAISKINDLDADEFLDHVARNHPAPQAPRYIYKLEQALDAM

SEQ ID NO: 13369 - protein, 565 aa, Escherichia coli DEC8A; identical to SEQ ID NO: 6492

SEQ ID NO: 13370 - protein, 207 aa, Escherichia coli DEC8A; identical to SEQ ID NO: 5743

SEQ ID NO: 13371 - protein, 732 aa, Escherichia coli DEC8A; identical to SEQ ID NO: 8819

SEQ ID NO: 13372 - protein, 539 aa, Escherichia coli DEC8A; identical to SEQ ID NO: 6525

SEQ ID NO: 13373 - protein, 646 aa, Escherichia coli DEC8A; identical to SEQ ID NO: 7882

SEQ ID NO: 13374 - protein, 236 aa, Escherichia coli DEC8A; identical to SEQ ID NO: 6472

SEQ ID NO: 13375 - protein, 118 aa, Escherichia coli DEC8A [sequence omitted]

SEQ ID NO: 13376 - protein, 387 aa, Escherichia coli DEC8A; identical to SEQ ID NO: 7356

SEQ ID NO: 13377 - protein, 111 aa, Escherichia coli DEC8A; identical to SEQ ID NO: 7885

SEQ ID NO: 13378 - protein, 826 aa, Escherichia coli DEC8A
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGGWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 13379 - protein, 224 aa, Escherichia coli DEC8A; identical to SEQ ID NO: 6435

SEQ ID NO: 13380 - protein, 641 aa, Escherichia coli DEC8A; identical to SEQ ID NO: 7667

SEQ ID NO: 13381 - protein, 162 aa, Escherichia coli DEC8A; identical to SEQ ID NO: 5896

SEQ ID NO: 13382 - protein, 363 aa, Escherichia coli DEC8A; identical to SEQ ID NO: 7893

SEQ ID NO: 13383 - protein, 669 aa, Escherichia coli DEC8A; identical to SEQ ID NO: 8890

SEQ ID NO: 13384 - protein, 200 aa, Escherichia coli DEC8A; identical to SEQ ID NO: 6311

SEQ ID NO: 13385 - protein, 250 aa, Escherichia coli DEC8A; identical to SEQ ID NO: 7896

SEQ ID NO: 13386 - protein, 597 aa, Escherichia coli DEC8A
MLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLSDGSHPPFGAEVKNDNEQTVGLVDDDGNVYLAGVKPGEHMSVFWSGVAHCDINLPDPLPADLFNGLLLPCQHKGNVAPITSPAVKPAIQEQTQRVTPTEPPTSISVNQ

SEQ ID NO: 13387 - protein, 518 aa, Escherichia coli DEC8A; identical to SEQ ID NO: 6358

SEQ ID NO: 13388 - protein, 370 aa, Escherichia coli DEC8A
MKKITVALSAVAASVLMAMSAQAAEIYNKDGNKLDLYGKVNAEHYFSSSASDDGDKTYARLGFKGETQINDQLTGFGQWEYEFKGNRTESEGSDKDKTRLAFAGLRFADYGSIDYGRNYGVAYDIGAWTDVLPEFGGDTWTQTDVFMTQRATGVATYRNNDFFGLVDGLNFALQYQGKNDSAAKVNNWKGRDVVESNGDGFGLSATYDYEGFGVGATYAKSDRTDGQVSYAKKDPLNASGKTAEVWATGLKYDANNIYLAATYSETQNMTVFGDDFIANKAKNFEAVAQYQFDFGLRPSIAYLHSRGENIGAFGSQDLVEYIDLGATYYFNKNMSAFVDYKINLIDESEFTKRSEVATDNIVAVGMTYQF

SEQ ID NO: 13389 - protein, 432 aa, Escherichia coli DEC8A; identical to SEQ ID NO: 5727

SEQ ID NO: 13390 - protein, 359 aa, Escherichia coli DEC8A; identical to SEQ ID NO: 5847

SEQ ID NO: 13391 - protein, 613 aa, Escherichia coli DEC8A
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKT

SEQ ID NO: 13392 - protein, 696 aa, Escherichia coli DEC8A
MQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGCFVYLNGIQDDSKLTLRWGDKSCFIQPPNSSNLTTGTVILPCISQN

SEQ ID NO: 13393 - protein, 107 aa, Escherichia coli DEC8A; identical to SEQ ID NO: 9122

SEQ ID NO: 13394 - protein, 231 aa, Escherichia coli DEC8A; identical to SEQ ID NO: 6351

SEQ ID NO: 13395 - protein, 721 aa, Escherichia coli DEC8A; identical to SEQ ID NO: 9124

SEQ ID NO: 13396 - protein, 678 aa, Escherichia coli DEC8A; identical to SEQ ID NO: 6353

SEQ ID NO: 13397 - protein, 386 aa, Escherichia coli DEC8A; identical to SEQ ID NO: 7908

SEQ ID NO: 13398 - protein, 840 aa, Escherichia coli DEC8A; identical to SEQ ID NO: 8997

SEQ ID NO: 13399 - protein, 243 aa, Escherichia coli DEC8A; identical to SEQ ID NO: 6145

SEQ ID NO: 13400 - protein, 208 aa, Escherichia coli DEC8A; identical to SEQ ID NO: 5717

SEQ ID NO: 13401 - protein, 614 aa, Escherichia coli DEC8A; identical to SEQ ID NO: 7913

SEQ ID NO: 13402 - protein, 445 aa, Escherichia coli DEC8A; identical to SEQ ID NO: 9001

SEQ ID NO: 13403 - protein, 237 aa, Escherichia coli DEC8A; identical to SEQ ID NO: 6384

SEQ ID NO: 13404 - protein, 368 aa, Escherichia coli DEC8A; identical to SEQ ID NO: 7849

SEQ ID NO: 13405 - protein, 218 aa, Escherichia coli DEC8A
MFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 13406 - protein, 856 aa, Escherichia coli DEC8A
MAGFFVRLFVACAFAAQTPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 13407 - protein, 415 aa, Escherichia coli DEC8A
MYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQANISSSVISNASNFMIRVNALQQNSKAKILSQPSIITLNNMQAILDKNVTFYTKVSGEKVASLESITSGTLLRVTPRILDDSSNSLTGKRRERVRLLLDIQDGNQSTNQSNAQDASSTLPEVQNSEMTTEATLSAGESLLLGGFIQDKESSSKDGIPLLSDIPVIGSLFSSTVKQKHSVVRLFLIKATPIKSASSE

SEQ ID NO: 13408 - protein, 302 aa, Escherichia coli DEC8A
MTVKISGVLKDGTGKPVQNCTIVLKARRTSSTVVVNTVASENPDEAGRYSMDVEYGQYSVILLVEGFPPSHAGTITVYEDSQPGTLNDFLGAMSEDDVRPEALRRFELMVEEAARHAEEAKKNAGEAETSARNAGISASQAEESAANADTSAGDASESARQAAESAAAAKQSEEASSSSASAAAQKASESLQSATDAELSKKTAESAAGNAARDATTAAEKARESAESAQSAEQSRIAAEEAVNRIPTVVGPPGPKGEPGPAGPQGPKGDKGERGDTGPVGATGERGPAGDAGPAGPQGPKR

SEQ ID NO: 13409 - protein, 119 aa, Escherichia coli DEC8A; identical to SEQ ID NO: 5986

SEQ ID NO: 13410 - protein, 998 aa, Escherichia coli DEC8A
MTVNKIKNIFNNATLTTKSAFNTASSSVRSAGKKLILLIPDNYEAQGVGINELVKAADELGIEIHRTERDDTAIANQFFGAAEKVVGLTERGVAIFAPQLDKLLQKYQKVGSKIGRTAENVGNNLGKAGTVLSALQNFTGIALSGMALDELLRKQREGEDISQNDIAKSSIELINQLVDTVSSINSTVDSFSEQLNQLGSFLSSKPRLSSVGGKLQNLPDLGSLGDGLDVVSGILSAVSASFILGNSDAHTGTKAAAGIELTTQVLGNVGKAVSQYILAQRMAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTFLIVNGKDTWSVKGIKNHKGVYDYSKLIQFVEKDNKHYQARMISELGDKDDVVYSGAGSSEVFAGEGHDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYRQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKSMVNITSVANDINKIISSVSGFDSGDERLASLYNLSLHQNNTHSTTLTTTV

SEQ ID NO: 13411 - protein, 784 aa, Escherichia coli DEC8B; identical to SEQ ID NO: 7852

SEQ ID NO: 13412 - protein, 170 aa, Escherichia coli DEC8B [sequence omitted]

SEQ ID NO: 13413 - protein, 866 aa, Escherichia coli DEC8B
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESNPVSCLAHYQQSSEAEKIAQSIILNGIRCQIQ

SEQ ID NO: 13414 - protein, 230 aa, Escherichia coli DEC8B; identical to SEQ ID NO: 7855

SEQ ID NO: 13415 - protein, 747 aa, Escherichia coli DEC8B; identical to SEQ ID NO: 6343

SEQ ID NO: 13416 - protein, 266 aa, Escherichia coli DEC8B; identical to SEQ ID NO: 5772

SEQ ID NO: 13417 - protein, 161 aa, Escherichia coli DEC8B; identical to SEQ ID NO: 5769

SEQ ID NO: 13418 - protein, 221 aa, Escherichia coli DEC8B; identical to SEQ ID NO: 7859

SEQ ID NO: 13419 - protein, 351 aa, Escherichia coli DEC8B; identical to SEQ ID NO: 6367

SEQ ID NO: 13420 - protein, 230 aa, Escherichia coli DEC8B; identical to SEQ ID NO: 7861

SEQ ID NO: 13421 - protein, 869 aa, Escherichia coli DEC8B; identical to SEQ ID NO: 7862

SEQ ID NO: 13422 - protein, 746 aa, Escherichia coli DEC8B; identical to SEQ ID NO: 6296

SEQ ID NO: 13423 - protein, 193 aa, Escherichia coli DEC8B
MRYLATLLLSLAVLITAGCGWHLRDTTQVPSTMKVMILDSGDPNGPLSRAVRNQLRLNGVELLDKETTREDVPSLRLGKVSIAKDTASVFRNGQTAEYQMIMTVNATVLIPGRDIYPISAKVFRSFFDNPQMALAKDNEQDMIVKEMYDRAAEQLIRKLPSIRAADIRSDKEQTSTTTDTPATPARVSTTLGN

SEQ ID NO: 13424 - protein, 243 aa, Escherichia coli DEC8B; identical to SEQ ID NO: 6463

SEQ ID NO: 13425 - protein, 816 aa, Escherichia coli DEC8B; identical to SEQ ID NO: 6462

SEQ ID NO: 13426 - protein, 430 aa, Escherichia coli DEC8B; identical to SEQ ID NO: 5758

SEQ ID NO: 13427 - protein, 331 aa, Escherichia coli DEC8B; identical to SEQ ID NO: 6456

SEQ ID NO: 13428 - protein, 760 aa, Escherichia coli DEC8B
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGVNANGQTDTFAIYAFDTLQITRDFELNGGIRLDNYHTEYDSATACGGSGRGAITCPTGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 13429 - protein, 203 aa, Escherichia coli DEC8B; identical to SEQ ID NO: 6414

SEQ ID NO: 13430 - protein, 361 aa, Escherichia coli DEC8B; identical to SEQ ID NO: 7868

SEQ ID NO: 13431 - protein, 224 aa, Escherichia coli DEC8B; identical to SEQ ID NO: 7869

SEQ ID NO: 13432 - protein, 606 aa, Escherichia coli DEC8B
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKITPG

SEQ ID NO: 13433 - protein, 128 aa, Escherichia coli DEC8B; identical to SEQ ID NO: 7871

SEQ ID NO: 13434 - protein, 669 aa, Escherichia coli DEC8B; identical to SEQ ID NO: 8890

SEQ ID NO: 13435 - protein, 998 aa, Escherichia coli DEC8B; identical to SEQ ID NO: 13410

SEQ ID NO: 13436 - protein, 191 aa, Escherichia coli DEC8B; identical to SEQ ID NO: 5748

SEQ ID NO: 13437 - protein, 232 aa, Escherichia coli DEC8B; identical to SEQ ID NO: 5747

SEQ ID NO: 13438 - protein, 729 aa, Escherichia coli DEC8B; identical to SEQ ID NO: 7878

SEQ ID NO: 13439 - protein, 213 aa, Escherichia coli DEC8B; identical to SEQ ID NO: 5744

SEQ ID NO: 13440 - protein, 407 aa, Escherichia coli DEC8B
MTERELSIIRALGEEFSTVLADLQRTFEEKMAAQAQAFEEKLASLSAVLQKHVTVDEVHPVLQAMVDDAVRPYPVPRDGRDYDPDVLQQAVNDAVANIPLPADGKSITPDDVRPMLEQMVKEAVSHIPAPRDGRDYDPEVLKQAVNDAVANIPVPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEIIPAIDDQKSFPRGTYATHLGGLWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRGAGGGK

SEQ ID NO: 13441 - protein, 203 aa, Escherichia coli DEC8B; identical to SEQ ID NO: 6347

SEQ ID NO: 13442 - protein, 207 aa, Escherichia coli DEC8B; identical to SEQ ID NO: 5743

SEQ ID NO: 13443 - protein, 700 aa, Escherichia coli DEC8B
MKIFSVRQTVLPALLVLSPVVFAADEQTMIVSTAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 13444 - protein, 236 aa, Escherichia coli DEC8B; identical to SEQ ID NO: 6472

SEQ ID NO: 13445 - protein, 539 aa, Escherichia coli DEC8B; identical to SEQ ID NO: 6525

SEQ ID NO: 13446 - protein, 344 aa, Escherichia coli DEC8B
MAVKISGVLKDGTGKPVENCTIQLKARRTSSTVVVNTVASENPDEAGRYSMDVEYGQYSVILLVEGFPPSHAGTITVYEDSRPGTLNDFLGAMSEDDVRPEALRRFELMVEEAARHAGEAKKNAGEAETSARNAGISASQAEENAANADTSAGDASESARQAAESAAAAKQSEEASSSSASAAAQKASESSQSAAEAELSRKTAESAAGNAARDATTATEKARESAESAQSAEQSRIAAEEAVNRIPTVVGPPGPKGEPGPAGPQGPKGDKGERGDTGPVGATGERGPAGDAGPAVPQGPKGDRGERGETGLTGNAGPQGPKGDTGAAGPAGPQGPKGETGAAG

SEQ ID NO: 13447 - protein, 111 aa, Escherichia coli DEC8B; identical to SEQ ID NO: 7885

SEQ ID NO: 13448 - protein, 118 aa, Escherichia coli DEC8B [sequence omitted]

SEQ ID NO: 13449 - protein, 387 aa, Escherichia coli DEC8B; identical to SEQ ID NO: 7356

SEQ ID NO: 13450 - protein, 162 aa, Escherichia coli DEC8B; identical to SEQ ID NO: 5896

SEQ ID NO: 13451 - protein, 363 aa, Escherichia coli DEC8B; identical to SEQ ID NO: 7893

SEQ ID NO: 13452 - protein, 826 aa, Escherichia coli DEC8B; identical to SEQ ID NO: 7342

SEQ ID NO: 13453 - protein, 224 aa, Escherichia coli DEC8B; identical to SEQ ID NO: 6435

SEQ ID NO: 13454 - protein, 650 aa, Escherichia coli DEC8B; identical to SEQ ID NO: 9042

SEQ ID NO: 13455 - protein, 200 aa, Escherichia coli DEC8B; identical to SEQ ID NO: 6311

SEQ ID NO: 13456 - protein, 89 aa, Escherichia coli DEC8B; identical to SEQ ID NO: 6233

SEQ ID NO: 13457 - protein, 881 aa, Escherichia coli DEC8B
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQNRHEENGGDDSNEISGNGTVGVNLGPWRMRADWQTNYQHTRSNDDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLSDGSHPPFGAEVKNDNEQTVGLVDDDGNVYLAGVKPGEHMSVFWSGVAHCDINLPDPLPADLFNGLLLPCQHKGNVAPITSPAVKPAIQEQTQRVTPTEPPTSISVNQ

SEQ ID NO: 13458 - protein, 250 aa, Escherichia coli DEC8B; identical to SEQ ID NO: 7896

SEQ ID NO: 13459 - protein, 274 aa, Escherichia coli DEC8B; identical to SEQ ID NO: 7895

SEQ ID NO: 13460 - protein, 518 aa, Escherichia coli DEC8B; identical to SEQ ID NO: 6358

SEQ ID NO: 13461 - protein, 61 aa, Escherichia coli DEC8B; identical to SEQ ID NO: 11399

SEQ ID NO: 13462 - protein, 432 aa, Escherichia coli DEC8B; identical to SEQ ID NO: 5727

SEQ ID NO: 13463 - protein, 359 aa, Escherichia coli DEC8B; identical to SEQ ID NO: 5847

SEQ ID NO: 13464 - protein, 678 aa, Escherichia coli DEC8B; identical to SEQ ID NO: 6353

SEQ ID NO: 13465 - protein, 806 aa, Escherichia coli DEC8B
MLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLDPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 13466 - protein, 231 aa, Escherichia coli DEC8B; identical to SEQ ID NO: 6351

SEQ ID NO: 13467 - protein, 258 aa, Escherichia coli DEC8B
MRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQANISSSVISNASNFMIRVNALQQNSKAKILSQPSIITLNNMQAILDKNVTFYTKVSGEKGGVSGKYYKRNIAESDTTYT

SEQ ID NO: 13468 - protein, 696 aa, Escherichia coli DEC8B; identical to SEQ ID NO: 13392

SEQ ID NO: 13469 - protein, 125 aa, Escherichia coli DEC8B; identical to SEQ ID NO: 7904

SEQ ID NO: 13470 - protein, 626 aa, Escherichia coli DEC8B
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTHSA

SEQ ID NO: 13471 - protein, 386 aa, Escherichia coli DEC8B; identical to SEQ ID NO: 7908

SEQ ID NO: 13472 - protein, 843 aa, Escherichia coli DEC8B; identical to SEQ ID NO: 7909

SEQ ID NO: 13473 - protein, 228 aa, Escherichia coli DEC8B; identical to SEQ ID NO: 6185

SEQ ID NO: 13474 - protein, 243 aa, Escherichia coli DEC8B; identical to SEQ ID NO: 6145

SEQ ID NO: 13475 - protein, 208 aa, Escherichia coli DEC8B; identical to SEQ ID NO: 5717

SEQ ID NO: 13476 - protein, 614 aa, Escherichia coli DEC8B; identical to SEQ ID NO: 7913

SEQ ID NO: 13477 - protein, 446 aa, Escherichia coli DEC8B; identical to SEQ ID NO: 6459

SEQ ID NO: 13478 - protein, 478 aa, Escherichia coli DEC8B; identical to SEQ ID NO: 5711

SEQ ID NO: 13479 - protein, 368 aa, Escherichia coli DEC8B; identical to SEQ ID NO: 7849

SEQ ID NO: 13480 - protein, 216 aa, Escherichia coli DEC8B
MAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 13481 - protein, 878 aa, Escherichia coli DEC8B
MSYLNLRLYQRNTQCLHIRKHRLAGFFVRLFVACAFAAQTPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 13482 - protein, 765 aa, Escherichia coli DEC8C; identical to SEQ ID NO: 8790

SEQ ID NO: 13483 - protein, 230 aa, Escherichia coli DEC8C; identical to SEQ ID NO: 7855

SEQ ID NO: 13484 - protein, 747 aa, Escherichia coli DEC8C; identical to SEQ ID NO: 8868

SEQ ID NO: 13485 - protein, 266 aa, Escherichia coli DEC8C; identical to SEQ ID NO: 5772

SEQ ID NO: 13486 - protein, 161 aa, Escherichia coli DEC8C; identical to SEQ ID NO: 5769

SEQ ID NO: 13487 - protein, 368 aa, Escherichia coli DEC8C; identical to SEQ ID NO: 8795

SEQ ID NO: 13488 - protein, 241 aa, Escherichia coli DEC8C
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRLAKLALPPDQAAEKLRFRRSANSLTLINPTPYYLTVTELNAGTRVLENALVPPMGESTVKLPSDAGSNITYRTINDYGALTPKMTGVME

SEQ ID NO: 13489 - protein, 878 aa, Escherichia coli DEC8C; identical to SEQ ID NO: 8797

SEQ ID NO: 13490 - protein, 784 aa, Escherichia coli DEC8C; identical to SEQ ID NO: 6283

SEQ ID NO: 13491 - protein, 170 aa, Escherichia coli DEC8C [sequence omitted]

SEQ ID NO: 13492 - protein, 221 aa, Escherichia coli DEC8C; identical to SEQ ID NO: 8798

SEQ ID NO: 13493 - protein, 351 aa, Escherichia coli DEC8C; identical to SEQ ID NO: 8799

SEQ ID NO: 13494 - protein, 230 aa, Escherichia coli DEC8C; identical to SEQ ID NO: 7861

SEQ ID NO: 13495 - protein, 780 aa, Escherichia coli DEC8C; identical to SEQ ID NO: 8875

SEQ ID NO: 13496 - protein, 325 aa, Escherichia coli DEC8C
MRGSLSAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTQANGDGFGFSTTYEYEGFGVGATYAKSDRTNNQVIYGNNSLNASGQNAEVWAAGLKYDANNIYLATTYSETQNMTVFGKNHIANKAQNFEVVAQYQFDFGLRPSVAYLQSKGKDLGAWGDQDLVEYIDVGATYYFNKNMSTFVDYKINLIDKSDFTKASGVATDDIVAVGMVYQF

SEQ ID NO: 13497 - protein, 673 aa, Escherichia coli DEC8C
MPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDILVNQTLTLGTEWNQQRMKDLSSNTQALTGANTGGAIDGMSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 13498 - protein, 193 aa, Escherichia coli DEC8C; identical to SEQ ID NO: 6300

SEQ ID NO: 13499 - protein, 430 aa, Escherichia coli DEC8C; identical to SEQ ID NO: 5758

SEQ ID NO: 13500 - protein, 816 aa, Escherichia coli DEC8C; identical to SEQ ID NO: 8806

SEQ ID NO: 13501 - protein, 243 aa, Escherichia coli DEC8C; identical to SEQ ID NO: 8805

SEQ ID NO: 13502 - protein, 361 aa, Escherichia coli DEC8C; identical to SEQ ID NO: 7868

SEQ ID NO: 13503 - protein, 233 aa, Escherichia coli DEC8C; identical to SEQ ID NO: 6327

SEQ ID NO: 13504 - protein, 606 aa, Escherichia coli DEC8C
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGSNALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKITPG

SEQ ID NO: 13505 - protein, 226 aa, Escherichia coli DEC8C; identical to SEQ ID NO: 7934

SEQ ID NO: 13506 - protein, 394 aa, Escherichia coli DEC8C
MAVKISGVLKDGTGKPVENCTIQLKARRTSSTVVVNTVASENPDEAGRYSMDVEYGQYSVILLVEGFPPSHAGTITVYEDSQPGTLNDFLGAMSEDDVRPEALRRFELMLEEAARHAEEAKKNAGEAETSARNAGISASQAEESAANADTSAGEASESARQAAESAAAAKQSEEASSSSASAAAQKASESSQSAAEAELSRKTAESAAGNAARDATTATEKARESAESAQSAEQSRIAAEEAVNRIPTVVGPPGPKGEQGPAGPQGPKGDKGERGDTGPVGATGERGPAGDAGPAGPQGPKGDRGERGETGLTGNAGPRVQREIPVRQARQARQAHRDRKEKQVRLARWGQPDLRDRRATRGRHKSVFVWGRRALLRQTAMAGSRIQMVHSSPD

SEQ ID NO: 13507 - protein, 331 aa, Escherichia coli DEC8C; identical to SEQ ID NO: 6456

SEQ ID NO: 13508 - protein, 760 aa, Escherichia coli DEC8C; identical to SEQ ID NO: 6322

SEQ ID NO: 13509 - protein, 203 aa, Escherichia coli DEC8C; identical to SEQ ID NO: 6414

SEQ ID NO: 13510 - protein, 696 aa, Escherichia coli DEC8C; identical to SEQ ID NO: 6320

SEQ ID NO: 13511 - protein, 699 aa, Escherichia coli DEC8C; identical to SEQ ID NO: 7915

SEQ ID NO: 13512 - protein, 191 aa, Escherichia coli DEC8C; identical to SEQ ID NO: 5748

SEQ ID NO: 13513 - protein, 232 aa, Escherichia coli DEC8C; identical to SEQ ID NO: 5747

SEQ ID NO: 13514 - protein, 703 aa, Escherichia coli DEC8C
MALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQHIDVNSPTWGGLPRWNTDGSSNSYDRARSTAPDWAYNDKEINKVFMTLKQRFADTWQATLNATHSEVEFDSKMMYVDAYVNKADGMLIGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHIKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 13515 - protein, 210 aa, Escherichia coli DEC8C; identical to SEQ ID NO: 8964

SEQ ID NO: 13516 - protein, 207 aa, Escherichia coli DEC8C; identical to SEQ ID NO: 5743

SEQ ID NO: 13517 - protein, 203 aa, Escherichia coli DEC8C; identical to SEQ ID NO: 6347

SEQ ID NO: 13518 - protein, 565 aa, Escherichia coli DEC8C; identical to SEQ ID NO: 6492

SEQ ID NO: 13519 - protein, 346 aa, Escherichia coli DEC8C
MAVKISGVLKDGTGKPVENCTIQLKARRTSSTVVVNTVASENPDEAGRYSMDVEYGQYSVILLVEGFPPSHAGTITVYEDSQPGTLNDFLGAMSEDDVRPEALRRFELMVEEVARHAEEAKKNAGEAETSARNAGISASQAEESAANADTSAGEASESARQAAESAASAKQSEDASSSSASAAAQKASESSQSAAEAELSRKTAESAAGNAARDATTATEKARESAESAQSAEQSRIAAEEAVNRIPTVVGPPGPKGEQGPAGPQGPKGDKGERGETGLTGNAGPQGPKGDTGAAGPAGPQGPKGETGAAGPVGATGPQGPKGDPGETQIRFRLGPASIIETNSNG

SEQ ID NO: 13520 - protein, 672 aa, Escherichia coli DEC8C; identical to SEQ ID NO: 10263

SEQ ID NO: 13521 - protein, 539 aa, Escherichia coli DEC8C; identical to SEQ ID NO: 6525

SEQ ID NO: 13522 - protein, 883 aa, Escherichia coli DEC8C
MTAFRAAFKAYRMHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKIALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVITVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 13523 - protein, 236 aa, Escherichia coli DEC8C; identical to SEQ ID NO: 6472

SEQ ID NO: 13524 - protein, 998 aa, Escherichia coli DEC8C; identical to SEQ ID NO: 5650

SEQ ID NO: 13525 - protein, 111 aa, Escherichia coli DEC8C; identical to SEQ ID NO: 7885

SEQ ID NO: 13526 - protein, 118 aa, Escherichia coli DEC8C [sequence omitted]

SEQ ID NO: 13527 - protein, 673 aa, Escherichia coli DEC8C
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGLINIVTQQPDSTPRGYIEGGVSSRDSYRSKFNLSGPIEDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPDGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 13528 - protein, 826 aa, Escherichia coli DEC8C
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKHSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYHNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 13529 - protein, 224 aa, Escherichia coli DEC8C; identical to SEQ ID NO: 6435

SEQ ID NO: 13530 - protein, 641 aa, Escherichia coli DEC8C
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPSYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 13531 - protein, 162 aa, Escherichia coli DEC8C; identical to SEQ ID NO: 5896

SEQ ID NO: 13532 - protein, 363 aa, Escherichia coli DEC8C; identical to SEQ ID NO: 7893

SEQ ID NO: 13533 - protein, 200 aa, Escherichia coli DEC8C; identical to SEQ ID NO: 6311

SEQ ID NO: 13534 - protein, 274 aa, Escherichia coli DEC8C; identical to SEQ ID NO: 7895

SEQ ID NO: 13535 - protein, 250 aa, Escherichia coli DEC8C; identical to SEQ ID NO: 8842

SEQ ID NO: 13536 - protein, 881 aa, Escherichia coli DEC8C; identical to SEQ ID NO: 8916

SEQ ID NO: 13537 - protein, 518 aa, Escherichia coli DEC8C; identical to SEQ ID NO: 6358

SEQ ID NO: 13538 - protein, 89 aa, Escherichia coli DEC8C; identical to SEQ ID NO: 6232

SEQ ID NO: 13539 - protein, 432 aa, Escherichia coli DEC8C; identical to SEQ ID NO: 5727

SEQ ID NO: 13540 - protein, 514 aa, Escherichia coli DEC8C
MCNEKISFLFFTALFCCSAQAAPSSLEKRLGKNEYFIITKSSPVRAILNDFAANYSIPVFISNSVNDDFSGEIKNEKPMKVLEKLSRLYHLTWYYDENILYIYKTNEISRSIITPTYLDIDSLLKYLRDTISVNKNSCNVRKITTFNSIEVRGVPECIKYITSLSESLDKEAQSKAKNKDVVRVFKLNYASATDITYKYRDQNVVVPGVVSILKTMASNGSLPSTGKGAVERNGNLFDNSVKISADPRLNAVVVKDREITMDIYRQLISELDIEQRQIEISVSIIDVDANDLQQLGVNWSGTLNAGQGSIAFNSSTAQANLSSSVISNANNFMIRVNALQQNSKAKILSQPSIITLNNMQAILDKNVTFYTKVSGEKVASLESITSGTLLRVTPRILDDNSNSLTGKRRERVRLLLDIQDGNQSTNQSNAQDASSILPEVQNSEMTTEATLSAGESLLLGGFIQDKESSSKDGIPLLSDIPVIGNLFSSTTKQKHSVVRLFLIKATPIKSASSE

SEQ ID NO: 13541 - protein, 834 aa, Escherichia coli DEC8C; identical to SEQ ID NO: 8846

SEQ ID NO: 13542 - protein, 249 aa, Escherichia coli DEC8C; identical to SEQ ID NO: 6450

SEQ ID NO: 13543 - protein, 231 aa, Escherichia coli DEC8C; identical to SEQ ID NO: 6351

SEQ ID NO: 13544 - protein, 721 aa, Escherichia coli DEC8C; identical to SEQ ID NO: 8922

SEQ ID NO: 13545 - protein, 678 aa, Escherichia coli DEC8C; identical to SEQ ID NO: 6353

SEQ ID NO: 13546 - protein, 359 aa, Escherichia coli DEC8C; identical to SEQ ID NO: 5847

SEQ ID NO: 13547 - protein, 696 aa, Escherichia coli DEC8C
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRNVLKRDKWGLAGQLRELKESNLILNSLLLTPLGESHLVTVGGEYQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPDLKPEESVSYEAGVYYDNPAGLNANITGFMTDFSNKIVSYSINDNTNSYINSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKVTDALTLNAAVNNLLNKDYSDVSLYSAGKSTLYAGDYFQTGSSTTGYVIPERNYWMSLNYQF

SEQ ID NO: 13548 - protein, 386 aa, Escherichia coli DEC8C; identical to SEQ ID NO: 7908

SEQ ID NO: 13549 - protein, 840 aa, Escherichia coli DEC8C; identical to SEQ ID NO: 8997

SEQ ID NO: 13550 - protein, 228 aa, Escherichia coli DEC8C; identical to SEQ ID NO: 6185

SEQ ID NO: 13551 - protein, 243 aa, Escherichia coli DEC8C; identical to SEQ ID NO: 6145

SEQ ID NO: 13552 - protein, 208 aa, Escherichia coli DEC8C; identical to SEQ ID NO: 5717

SEQ ID NO: 13553 - protein, 614 aa, Escherichia coli DEC8C; identical to SEQ ID NO: 6303

SEQ ID NO: 13554 - protein, 446 aa, Escherichia coli DEC8C; identical to SEQ ID NO: 6459

SEQ ID NO: 13555 - protein, 478 aa, Escherichia coli DEC8C; identical to SEQ ID NO: 5711

SEQ ID NO: 13556 - protein, 774 aa, Escherichia coli DEC8C; identical to SEQ ID NO: 8932

SEQ ID NO: 13557 - protein, 120 aa, Escherichia coli DEC8C; identical to SEQ ID NO: 5799

SEQ ID NO: 13558 - protein, 371 aa, Escherichia coli DEC8C
MKKITVALSAVAASVLMAMSAQAAEIYNKDGNKLDLYGKVNAEHYFSSSASDDGDKTYARMGFKGETQINDQLTGFGQWEYEFKGNRTETEGSDKDKTRLAFAGLRFGDYGSLDYGRNYGVAYDVGAWTDVLPEFGGDTWTQTDVFMTQRATGVATYRNNDFFGLVDGLNFALQYQGKNDSAAKVNNWKGRDVVESNGDGFGLSATYDYEGFGIGATYAKSDRTDGQVSYAKAPLNLNASGKTAEVWATGLKYDANNIYLATTYSETQNMTVFGDDHIANKAKNFEAVAQYQFDFGLRPSIAYLHSRGENIGAFGNQDLVEYIDVGATYYFNKNMSAFVDYKINLIDESEFTKTSEVATDNIVAVGMTYQF

SEQ ID NO: 13559 - protein, 170 aa, Escherichia coli DEC8D [sequence omitted]

SEQ ID NO: 13560 - protein, 241 aa, Escherichia coli DEC8D; identical to SEQ ID NO: 6143

SEQ ID NO: 13561 - protein, 878 aa, Escherichia coli DEC8D; identical to SEQ ID NO: 8797

SEQ ID NO: 13562 - protein, 866 aa, Escherichia coli DEC8D; identical to SEQ ID NO: 7345

SEQ ID NO: 13563 - protein, 246 aa, Escherichia coli DEC8D; identical to SEQ ID NO: 6342

SEQ ID NO: 13564 - protein, 747 aa, Escherichia coli DEC8D; identical to SEQ ID NO: 8868

SEQ ID NO: 13565 - protein, 266 aa, Escherichia coli DEC8D; identical to SEQ ID NO: 5772

SEQ ID NO: 13566 - protein, 161 aa, Escherichia coli DEC8D; identical to SEQ ID NO: 5769

SEQ ID NO: 13567 - protein, 784 aa, Escherichia coli DEC8D; identical to SEQ ID NO: 6283

SEQ ID NO: 13568 - protein, 236 aa, Escherichia coli DEC8D; identical to SEQ ID NO: 6472

SEQ ID NO: 13569 - protein, 351 aa, Escherichia coli DEC8D; identical to SEQ ID NO: 8799

SEQ ID NO: 13570 - protein, 221 aa, Escherichia coli DEC8D; identical to SEQ ID NO: 8798

SEQ ID NO: 13571 - protein, 222 aa, Escherichia coli DEC8D; identical to SEQ ID NO: 8943

SEQ ID NO: 13572 - protein, 869 aa, Escherichia coli DEC8D; identical to SEQ ID NO: 8801

SEQ ID NO: 13573 - protein, 360 aa, Escherichia coli DEC8D; identical to SEQ ID NO: 8802

SEQ ID NO: 13574 - protein, 424 aa, Escherichia coli DEC8D
MTTSNWVQYEHTRNSRIPEGLAGGTEGKFNEKATQDFVDIDLDDVMLHSEVNLPIDILVNQTLTLGTEWNQQRMKDLSSNTQALTGANTGGAIDGMSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 13575 - protein, 193 aa, Escherichia coli DEC8D; identical to SEQ ID NO: 6300

SEQ ID NO: 13576 - protein, 243 aa, Escherichia coli DEC8D
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALREKAGEKVELQLQVSQQGNQLTLKNPTAYYLTIAYLGRNEKGVLPGFKTVMVAPFSTVNTNIGNYSGSQFYLGYMDDYGALRMTTLNYSGQCHLQAVEAKK

SEQ ID NO: 13577 - protein, 816 aa, Escherichia coli DEC8D; identical to SEQ ID NO: 8806

SEQ ID NO: 13578 - protein, 430 aa, Escherichia coli DEC8D; identical to SEQ ID NO: 5758

SEQ ID NO: 13579 - protein, 331 aa, Escherichia coli DEC8D; identical to SEQ ID NO: 6456

SEQ ID NO: 13580 - protein, 203 aa, Escherichia coli DEC8D; identical to SEQ ID NO: 6414

SEQ ID NO: 13581 - protein, 361 aa, Escherichia coli DEC8D; identical to SEQ ID NO: 7868

SEQ ID NO: 13582 - protein, 224 aa, Escherichia coli DEC8D; identical to SEQ ID NO: 7869

SEQ ID NO: 13583 - protein, 866 aa, Escherichia coli DEC8D; identical to SEQ ID NO: 6328

SEQ ID NO: 13584 - protein, 130 aa, Escherichia coli DEC8D; identical to SEQ ID NO: 8814

SEQ ID NO: 13585 - protein, 760 aa, Escherichia coli DEC8D; identical to SEQ ID NO: 6322

SEQ ID NO: 13586 - protein, 191 aa, Escherichia coli DEC8D; identical to SEQ ID NO: 5748

SEQ ID NO: 13587 - protein, 232 aa, Escherichia coli DEC8D; identical to SEQ ID NO: 5747

SEQ ID NO: 13588 - protein, 729 aa, Escherichia coli DEC8D; identical to SEQ ID NO: 8894

SEQ ID NO: 13589 - protein, 213 aa, Escherichia coli DEC8D; identical to SEQ ID NO: 5744

SEQ ID NO: 13590 - protein, 203 aa, Escherichia coli DEC8D; identical to SEQ ID NO: 6347

SEQ ID NO: 13591 - protein, 565 aa, Escherichia coli DEC8D; identical to SEQ ID NO: 6492

SEQ ID NO: 13592 - protein, 207 aa, Escherichia coli DEC8D; identical to SEQ ID NO: 5743

SEQ ID NO: 13593 - protein, 539 aa, Escherichia coli DEC8D; identical to SEQ ID NO: 6525

SEQ ID NO: 13594 - protein, 672 aa, Escherichia coli DEC8D; identical to SEQ ID NO: 10263

SEQ ID NO: 13595 - protein, 185 aa, Escherichia coli DEC8D; identical to SEQ ID NO: 9410

SEQ ID NO: 13596 - protein, 998 aa, Escherichia coli DEC8D; identical to SEQ ID NO: 5650

SEQ ID NO: 13597 - protein, 102 aa, Escherichia coli DEC8D; identical to SEQ ID NO: 6285

SEQ ID NO: 13598 - protein, 407 aa, Escherichia coli DEC8D; identical to SEQ ID NO: 9304

SEQ ID NO: 13599 - protein, 673 aa, Escherichia coli DEC8D; identical to SEQ ID NO: 8833

SEQ ID NO: 13600 - protein, 826 aa, Escherichia coli DEC8D; identical to SEQ ID NO: 8836

SEQ ID NO: 13601 - protein, 224 aa, Escherichia coli DEC8D; identical to SEQ ID NO: 6435

SEQ ID NO: 13602 - protein, 641 aa, Escherichia coli DEC8D; identical to SEQ ID NO: 7667

SEQ ID NO: 13603 - protein, 162 aa, Escherichia coli DEC8D; identical to SEQ ID NO: 5896

SEQ ID NO: 13604 - protein, 363 aa, Escherichia coli DEC8D; identical to SEQ ID NO: 7893

SEQ ID NO: 13605 - protein, 118 aa, Escherichia coli DEC8D [sequence omitted]

SEQ ID NO: 13606 - protein, 200 aa, Escherichia coli DEC8D; identical to SEQ ID NO: 6311

SEQ ID NO: 13607 - protein, 274 aa, Escherichia coli DEC8D; identical to SEQ ID NO: 7895

SEQ ID NO: 13608 - protein, 250 aa, Escherichia coli DEC8D; identical to SEQ ID NO: 8842

SEQ ID NO: 13609 - protein, 881 aa, Escherichia coli DEC8D; identical to SEQ ID NO: 8916

SEQ ID NO: 13610 - protein, 518 aa, Escherichia coli DEC8D; identical to SEQ ID NO: 6358

SEQ ID NO: 13611 - protein, 243 aa, Escherichia coli DEC8D; identical to SEQ ID NO: 6145

SEQ ID NO: 13612 - protein, 359 aa, Escherichia coli DEC8D; identical to SEQ ID NO: 5847

SEQ ID NO: 13613 - protein, 669 aa, Escherichia coli DEC8D; identical to SEQ ID NO: 8989

SEQ ID NO: 13614 - protein, 834 aa, Escherichia coli DEC8D; identical to SEQ ID NO: 8846

SEQ ID NO: 13615 - protein, 249 aa, Escherichia coli DEC8D; identical to SEQ ID NO: 6450

SEQ ID NO: 13616 - protein, 231 aa, Escherichia coli DEC8D; identical to SEQ ID NO: 6351

SEQ ID NO: 13617 - protein, 823 aa, Escherichia coli DEC8D; identical to SEQ ID NO: 8993

SEQ ID NO: 13618 - protein, 678 aa, Escherichia coli DEC8D; identical to SEQ ID NO: 6353

SEQ ID NO: 13619 - protein, 432 aa, Escherichia coli DEC8D; identical to SEQ ID NO: 5727

SEQ ID NO: 13620 - protein, 386 aa, Escherichia coli DEC8D; identical to SEQ ID NO: 7908

SEQ ID NO: 13621 - protein, 840 aa, Escherichia coli DEC8D; identical to SEQ ID NO: 8997

SEQ ID NO: 13622 - protein, 228 aa, Escherichia coli DEC8D; identical to SEQ ID NO: 6185

SEQ ID NO: 13623 - protein, 614 aa, Escherichia coli DEC8D; identical to SEQ ID NO: 6303

SEQ ID NO: 13624 - protein, 208 aa, Escherichia coli DEC8D; identical to SEQ ID NO: 5717

SEQ ID NO: 13625 - protein, 514 aa, Escherichia coli DEC8D; identical to SEQ ID NO: 9000

SEQ ID NO: 13626 - protein, 446 aa, Escherichia coli DEC8D; identical to SEQ ID NO: 6459

SEQ ID NO: 13627 - protein, 237 aa, Escherichia coli DEC8D; identical to SEQ ID NO: 9002

SEQ ID NO: 13628 - protein, 478 aa, Escherichia coli DEC8D; identical to SEQ ID NO: 5711

SEQ ID NO: 13629 - protein, 774 aa, Escherichia coli DEC8D; identical to SEQ ID NO: 8932

SEQ ID NO: 13630 - protein, 368 aa, Escherichia coli DEC8D; identical to SEQ ID NO: 8795

SEQ ID NO: 13631 - protein, 121 aa, Escherichia coli DEC8D
MNAILSVQGASAPVKKKSFFSKFTRLNMLRLVRAVIPAAVLMMFFPQLAMAAGGAGQDLMASGNTTVKATFGKDSSVVKWVVLAEVLVGAVMYMMTKNVKFLAGFAIISVFIAVGMAVVGL

SEQ ID NO: 13632 - protein, 784 aa, Escherichia coli DEC8E; identical to SEQ ID NO: 7852

SEQ ID NO: 13633 - protein, 170 aa, Escherichia coli DEC8E [sequence omitted]

SEQ ID NO: 13634 - protein, 765 aa, Escherichia coli DEC8E; identical to SEQ ID NO: 7854

SEQ ID NO: 13635 - protein, 230 aa, Escherichia coli DEC8E; identical to SEQ ID NO: 7855

SEQ ID NO: 13636 - protein, 747 aa, Escherichia coli DEC8E; identical to SEQ ID NO: 6343

SEQ ID NO: 13637 - protein, 266 aa, Escherichia coli DEC8E; identical to SEQ ID NO: 5772

SEQ ID NO: 13638 - protein, 161 aa, Escherichia coli DEC8E; identical to SEQ ID NO: 5769

SEQ ID NO: 13639 - protein, 221 aa, Escherichia coli DEC8E; identical to SEQ ID NO: 7859

SEQ ID NO: 13640 - protein, 351 aa, Escherichia coli DEC8E; identical to SEQ ID NO: 6367

SEQ ID NO: 13641 - protein, 230 aa, Escherichia coli DEC8E; identical to SEQ ID NO: 7861

SEQ ID NO: 13642 - protein, 869 aa, Escherichia coli DEC8E; identical to SEQ ID NO: 7862

SEQ ID NO: 13643 - protein, 746 aa, Escherichia coli DEC8E; identical to SEQ ID NO: 6296

SEQ ID NO: 13644 - protein, 193 aa, Escherichia coli DEC8E
MRYLATLLLSLAVLITAGCGWHLRDTTQVPSTMKVMILDSSDPNGPLSRAVRNQLRLNGVELLDKETTRKDVPSLRLGKVSIAKDTASVFRNGQTAEYQMIMTVNATVLIPGRDIYPISAKVFRSFFDNPQMALAKDNEQDMIVKEMYDRAAEQLIRKLPSIRAADIRSDKEQTSTTTDTPATPARVSTTLGN

SEQ ID NO: 13645 - protein, 243 aa, Escherichia coli DEC8E; identical to SEQ ID NO: 6463

SEQ ID NO: 13646 - protein, 816 aa, Escherichia coli DEC8E; identical to SEQ ID NO: 6462

SEQ ID NO: 13647 - protein, 430 aa, Escherichia coli DEC8E; identical to SEQ ID NO: 5758

SEQ ID NO: 13648 - protein, 331 aa, Escherichia coli DEC8E; identical to SEQ ID NO: 6456

SEQ ID NO: 13649 - protein, 760 aa, Escherichia coli DEC8E; identical to SEQ ID NO: 13428

SEQ ID NO: 13650 - protein, 203 aa, Escherichia coli DEC8E; identical to SEQ ID NO: 6414

SEQ ID NO: 13651 - protein, 361 aa, Escherichia coli DEC8E; identical to SEQ ID NO: 7868

SEQ ID NO: 13652 - protein, 224 aa, Escherichia coli DEC8E; identical to SEQ ID NO: 7869

SEQ ID NO: 13653 - protein, 851 aa, Escherichia coli DEC8E; identical to SEQ ID NO: 8686

SEQ ID NO: 13654 - protein, 130 aa, Escherichia coli DEC8E
MPVDRETLFELSIASVPSGKVENQSVKVAMRSVFKLFWRPEGLPGDPLEAYQQLRWTRNSQGVQLTNPAPYYINLIQLSVNGKALSNAGVVPPKSQRQTSWCQAIAPCHVAWRAINDYGGLSAKKEQNLP

SEQ ID NO: 13655 - protein, 669 aa, Escherichia coli DEC8E; identical to SEQ ID NO: 8890

SEQ ID NO: 13656 - protein, 732 aa, Escherichia coli DEC8E; identical to SEQ ID NO: 8819

SEQ ID NO: 13657 - protein, 191 aa, Escherichia coli DEC8E; identical to SEQ ID NO: 5748

SEQ ID NO: 13658 - protein, 232 aa, Escherichia coli DEC8E; identical to SEQ ID NO: 5747

SEQ ID NO: 13659 - protein, 729 aa, Escherichia coli DEC8E; identical to SEQ ID NO: 7878

SEQ ID NO: 13660 - protein, 213 aa, Escherichia coli DEC8E; identical to SEQ ID NO: 5744

SEQ ID NO: 13661 - protein, 359 aa, Escherichia coli DEC8E
MVVNTVASENPDEAGRYSMDVEYGQYSVILLVEGFPPSHAGTITVYEDSQPGTLNDFLGAMSEDDVRPEALRRFELMVEEVARHAEEAKKNAGEAETSARNAGISASQAEESAANADTSAGEASESARQAAESAASAKQSEDASSSSASAAAQKASESSQSAAEAELSRKTAESAAGNAARDATTATEKARESAESAQSAEQSRIAAEEAVNRIPTVVGPPGPKGEQGPAGPQGPKGDKGERGDTGPVGATGERDRQVMLVRQAREGPKGDRGEQGKTGLTGNAGPQGPKGDTGAAGPAGPQGPKGETGAAGPVGATGPQGPKGDPGETQIRFRLGPGNILRQTAMAGSRIQMVRSSPD

SEQ ID NO: 13662 - protein, 203 aa, Escherichia coli DEC8E; identical to SEQ ID NO: 6347

SEQ ID NO: 13663 - protein, 565 aa, Escherichia coli DEC8E; identical to SEQ ID NO: 6492

SEQ ID NO: 13664 - protein, 207 aa, Escherichia coli DEC8E; identical to SEQ ID NO: 5743

SEQ ID NO: 13665 - protein, 539 aa, Escherichia coli DEC8E; identical to SEQ ID NO: 6525

SEQ ID NO: 13666 - protein, 700 aa, Escherichia coli DEC8E; identical to SEQ ID NO: 7945

SEQ ID NO: 13667 - protein, 236 aa, Escherichia coli DEC8E; identical to SEQ ID NO: 6472

SEQ ID NO: 13668 - protein, 405 aa, Escherichia coli DEC8E
MTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLKQAVNDAVANIPQPADGKSITPDDVRPMLEQMVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 13669 - protein, 111 aa, Escherichia coli DEC8E; identical to SEQ ID NO: 7885

SEQ ID NO: 13670 - protein, 118 aa, Escherichia coli DEC8E [sequence omitted]

SEQ ID NO: 13671 - protein, 387 aa, Escherichia coli DEC8E
MKRKVLAMLVPALLVAGAANAAEIYNKNGNKLDLYGKVDARHTFSDNPGDDGDETIIELGFKGETQITDQLTGYGQALTKTKASDTEGSDNTYVKLAFAGQKFGEMGSFDYGRNYGVIYDVEAWTDMLPVFGGDSYTWTDNFMAGRANGVATYRNSDFFGLVEGLNFALQYQGNNEGSNAGEDQEGTKNGHEDVRFQNGDGFGLSTSYDFDFGLSLGAAYSNSDRTNSQVALGGYHYNEYSKFAGGDTAEAWTFGAKYDANNVYLAMMYAETRNMTPYGNVGIANKTQNFEAVAQYQFDFGLRPSLAYVYSKGKDLGGNDYNNNGHQEYVDQDLVNYVEIGATYYFNKNFSTYVDYKINLLDKDDDFYDNNGIATDDVVGVGLVYQF

SEQ ID NO: 13672 - protein, 826 aa, Escherichia coli DEC8E; identical to SEQ ID NO: 7342

SEQ ID NO: 13673 - protein, 224 aa, Escherichia coli DEC8E; identical to SEQ ID NO: 6435

SEQ ID NO: 13674 - protein, 438 aa, Escherichia coli DEC8E
MKRLRRRTRRRWSNWRPRPRKLWRARKRRRVVRRRRRQRRRMPGGQREIRVSRDLRGYRARQARQEQPDPRGHGVNVVNRGYRGQLVQPDRRGREESRVFRGRQVRLVPVVKPVPEEKKGDPGGPPGPKGDTGAKGDTGPAGPAGEKGEPGERGPQGLQGPPGPAGERGPTGEAGPAGQPGHKGDPGPAGPQGPAGERGPQGPQGVAGPVGPAGEPGAKGDKGDPGPAGPQGQPGPQGPAGETGPAGEPGPRGEPGPQGLKGDRGEPGPTGPQGPAGERGPQGPQGVAGPVGPAGEPGAKGDKGDPGGTELLASANTWTQPQTINGDLTVTGNGSFNDVQIRSDKRNKRNLVKLDNALDRLEALTGYLYEIQYSADGWQMSVGLIAQDAQKALPELVTEDDDMISGEKRLRLNYNGIIALLVEGFKALRHEIKELREK

SEQ ID NO: 13675 - protein, 641 aa, Escherichia coli DEC8E; identical to SEQ ID NO: 7667

SEQ ID NO: 13676 - protein, 162 aa, Escherichia coli DEC8E; identical to SEQ ID NO: 5896

SEQ ID NO: 13677 - protein, 363 aa, Escherichia coli DEC8E; identical to SEQ ID NO: 7893

SEQ ID NO: 13678 - protein, 200 aa, Escherichia coli DEC8E; identical to SEQ ID NO: 6311

SEQ ID NO: 13679 - protein, 274 aa, Escherichia coli DEC8E; identical to SEQ ID NO: 7895

SEQ ID NO: 13680 - protein, 250 aa, Escherichia coli DEC8E; identical to SEQ ID NO: 7896

SEQ ID NO: 13681 - protein, 460 aa, Escherichia coli DEC8E
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFLVLKLPGGSLTAGRYMAAHWEMKTISLRRLASVAICLHSARSRLMLLTRTPNWIKTPLMAKVRWTVTPSV

SEQ ID NO: 13682 - protein, 518 aa, Escherichia coli DEC8E; identical to SEQ ID NO: 6358

SEQ ID NO: 13683 - protein, 432 aa, Escherichia coli DEC8E; identical to SEQ ID NO: 5727

SEQ ID NO: 13684 - protein, 359 aa, Escherichia coli DEC8E; identical to SEQ ID NO: 5847

SEQ ID NO: 13685 - protein, 231 aa, Escherichia coli DEC8E; identical to SEQ ID NO: 6351

SEQ ID NO: 13686 - protein, 838 aa, Escherichia coli DEC8E; identical to SEQ ID NO: 7363

SEQ ID NO: 13687 - protein, 678 aa, Escherichia coli DEC8E; identical to SEQ ID NO: 6353

SEQ ID NO: 13688 - protein, 512 aa, Escherichia coli DEC8E; identical to SEQ ID NO: 6120

SEQ ID NO: 13689 - protein, 615 aa, Escherichia coli DEC8E; identical to SEQ ID NO: 10017

SEQ ID NO: 13690 - protein, 834 aa, Escherichia coli DEC8E; identical to SEQ ID NO: 8846

SEQ ID NO: 13691 - protein, 125 aa, Escherichia coli DEC8E; identical to SEQ ID NO: 7904

SEQ ID NO: 13692 - protein, 386 aa, Escherichia coli DEC8E; identical to SEQ ID NO: 7908

SEQ ID NO: 13693 - protein, 843 aa, Escherichia coli DEC8E
MHWMHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGIGSSSDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYNALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 13694 - protein, 228 aa, Escherichia coli DEC8E; identical to SEQ ID NO: 6185

SEQ ID NO: 13695 - protein, 243 aa, Escherichia coli DEC8E; identical to SEQ ID NO: 6145

SEQ ID NO: 13696 - protein, 208 aa, Escherichia coli DEC8E; identical to SEQ ID NO: 5717

SEQ ID NO: 13697 - protein, 614 aa, Escherichia coli DEC8E; identical to SEQ ID NO: 7913

SEQ ID NO: 13698 - protein, 446 aa, Escherichia coli DEC8E; identical to SEQ ID NO: 6459

SEQ ID NO: 13699 - protein, 89 aa, Escherichia coli DEC8E; identical to SEQ ID NO: 6232

SEQ ID NO: 13700 - protein, 368 aa, Escherichia coli DEC8E; identical to SEQ ID NO: 7849

SEQ ID NO: 13701 - protein, 241 aa, Escherichia coli DEC8E; identical to SEQ ID NO: 6134

SEQ ID NO: 13702 - protein, 863 aa, Escherichia coli DEC8E; identical to SEQ ID NO: 7851

SEQ ID NO: 13703 - protein, 784 aa, Escherichia coli DEC9A; identical to SEQ ID NO: 6283

SEQ ID NO: 13704 - protein, 170 aa, Escherichia coli DEC9A [sequence omitted]

SEQ ID NO: 13705 - protein, 765 aa, Escherichia coli DEC9A; identical to SEQ ID NO: 8790

SEQ ID NO: 13706 - protein, 230 aa, Escherichia coli DEC9A; identical to SEQ ID NO: 7855

SEQ ID NO: 13707 - protein, 747 aa, Escherichia coli DEC9A; identical to SEQ ID NO: 8868

SEQ ID NO: 13708 - protein, 266 aa, Escherichia coli DEC9A; identical to SEQ ID NO: 5772

SEQ ID NO: 13709 - protein, 161 aa, Escherichia coli DEC9A; identical to SEQ ID NO: 5769

SEQ ID NO: 13710 - protein, 221 aa, Escherichia coli DEC9A; identical to SEQ ID NO: 7859

SEQ ID NO: 13711 - protein, 351 aa, Escherichia coli DEC9A; identical to SEQ ID NO: 8799

SEQ ID NO: 13712 - protein, 230 aa, Escherichia coli DEC9A; identical to SEQ ID NO: 7861

SEQ ID NO: 13713 - protein, 869 aa, Escherichia coli DEC9A; identical to SEQ ID NO: 8801

SEQ ID NO: 13714 - protein, 746 aa, Escherichia coli DEC9A; identical to SEQ ID NO: 6296

SEQ ID NO: 13715 - protein, 193 aa, Escherichia coli DEC9A; identical to SEQ ID NO: 6300

SEQ ID NO: 13716 - protein, 243 aa, Escherichia coli DEC9A; identical to SEQ ID NO: 9157

SEQ ID NO: 13717 - protein, 816 aa, Escherichia coli DEC9A
MNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQIRYKLAAGQPRPSMSHQTENETFFSNDVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 13718 - protein, 430 aa, Escherichia coli DEC9A; identical to SEQ ID NO: 5758

SEQ ID NO: 13719 - protein, 331 aa, Escherichia coli DEC9A
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQADLNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGNEAGHE

SEQ ID NO: 13720 - protein, 760 aa, Escherichia coli DEC9A; identical to SEQ ID NO: 6322

SEQ ID NO: 13721 - protein, 203 aa, Escherichia coli DEC9A; identical to SEQ ID NO: 6414

SEQ ID NO: 13722 - protein, 361 aa, Escherichia coli DEC9A; identical to SEQ ID NO: 7868

SEQ ID NO: 13723 - protein, 224 aa, Escherichia coli DEC9A; identical to SEQ ID NO: 7869

SEQ ID NO: 13724 - protein, 851 aa, Escherichia coli DEC9A; identical to SEQ ID NO: 8686

SEQ ID NO: 13725 - protein, 130 aa, Escherichia coli DEC9A; identical to SEQ ID NO: 8814

SEQ ID NO: 13726 - protein, 191 aa, Escherichia coli DEC9A; identical to SEQ ID NO: 5748

SEQ ID NO: 13727 - protein, 232 aa, Escherichia coli DEC9A; identical to SEQ ID NO: 5747

SEQ ID NO: 13728 - protein, 729 aa, Escherichia coli DEC9A; identical to SEQ ID NO: 7878

SEQ ID NO: 13729 - protein, 213 aa, Escherichia coli DEC9A; identical to SEQ ID NO: 5744

SEQ ID NO: 13730 - protein, 203 aa, Escherichia coli DEC9A; identical to SEQ ID NO: 6347

SEQ ID NO: 13731 - protein, 565 aa, Escherichia coli DEC9A; identical to SEQ ID NO: 6492

SEQ ID NO: 13732 - protein, 207 aa, Escherichia coli DEC9A; identical to SEQ ID NO: 5743

SEQ ID NO: 13733 - protein, 539 aa, Escherichia coli DEC9A
MAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQTLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 13734 - protein, 700 aa, Escherichia coli DEC9A; identical to SEQ ID NO: 7945

SEQ ID NO: 13735 - protein, 111 aa, Escherichia coli DEC9A; identical to SEQ ID NO: 7885

SEQ ID NO: 13736 - protein, 118 aa, Escherichia coli DEC9A [sequence omitted]

SEQ ID NO: 13737 - protein, 673 aa, Escherichia coli DEC9A
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIEDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 13738 - protein, 826 aa, Escherichia coli DEC9A; identical to SEQ ID NO: 8836

SEQ ID NO: 13739 - protein, 224 aa, Escherichia coli DEC9A; identical to SEQ ID NO: 6435

SEQ ID NO: 13740 - protein, 631 aa, Escherichia coli DEC9A; identical to SEQ ID NO: 6430

SEQ ID NO: 13741 - protein, 162 aa, Escherichia coli DEC9A; identical to SEQ ID NO: 5896

SEQ ID NO: 13742 - protein, 363 aa, Escherichia coli DEC9A; identical to SEQ ID NO: 7893

SEQ ID NO: 13743 - protein, 200 aa, Escherichia coli DEC9A; identical to SEQ ID NO: 6311

SEQ ID NO: 13744 - protein, 274 aa, Escherichia coli DEC9A; identical to SEQ ID NO: 7895

SEQ ID NO: 13745 - protein, 250 aa, Escherichia coli DEC9A; identical to SEQ ID NO: 7896

SEQ ID NO: 13746 - protein, 881 aa, Escherichia coli DEC9A
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGTLGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLSDGSHPPFGAEVKNDNEQTVGLVDDDGNVYLAGVKPGEHMSVFWSGVAHCDINLPDPLPADLFNGLLLPCQHKGNVAPITSPAVKPAIQEQTQRVTPTEPPTSISVNQ

SEQ ID NO: 13747 - protein, 518 aa, Escherichia coli DEC9A; identical to SEQ ID NO: 6358

SEQ ID NO: 13748 - protein, 432 aa, Escherichia coli DEC9A; identical to SEQ ID NO: 5727

SEQ ID NO: 13749 - protein, 359 aa, Escherichia coli DEC9A; identical to SEQ ID NO: 5847

SEQ ID NO: 13750 - protein, 774 aa, Escherichia coli DEC9A
MTPLRVFRKTTPLVNAIRLSLLPLAGLSFSAFAAQVNIAPGSLDKALNQYAAHSGITISVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYGSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 13751 - protein, 686 aa, Escherichia coli DEC9A; identical to SEQ ID NO: 6453

SEQ ID NO: 13752 - protein, 834 aa, Escherichia coli DEC9A; identical to SEQ ID NO: 8846

SEQ ID NO: 13753 - protein, 249 aa, Escherichia coli DEC9A; identical to SEQ ID NO: 6450

SEQ ID NO: 13754 - protein, 231 aa, Escherichia coli DEC9A; identical to SEQ ID NO: 6351

SEQ ID NO: 13755 - protein, 838 aa, Escherichia coli DEC9A; identical to SEQ ID NO: 8849

SEQ ID NO: 13756 - protein, 678 aa, Escherichia coli DEC9A
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPAPVSTPAATTTAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMLAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 13757 - protein, 385 aa, Escherichia coli DEC9A; identical to SEQ ID NO: 9958

SEQ ID NO: 13758 - protein, 208 aa, Escherichia coli DEC9A; identical to SEQ ID NO: 5717

SEQ ID NO: 13759 - protein, 243 aa, Escherichia coli DEC9A
MSRKSCLIRLFKTIVSCKLFTAIILSVFLGQPALTYAGVVIGGTRVVYLSNNADKSISVFSKEEKIPYLIQAWVDPFNKEDKSKAPFTVIPPVSRLEPSQEKILRIIHTKGVSLPDDRESVFWLNIKNIPPSASNKATNSLEIAVKTRIKLFWRPANIRLIPEDAAPKVKWRREGRNLIAENPNPIHISVMDVIVDGHDVPLNMIRPFETLTLPLPANSAGGQMTWRFINDYGAVSDPIKMTL

SEQ ID NO: 13760 - protein, 843 aa, Escherichia coli DEC9A; identical to SEQ ID NO: 7909

SEQ ID NO: 13761 - protein, 614 aa, Escherichia coli DEC9A; identical to SEQ ID NO: 6303

SEQ ID NO: 13762 - protein, 446 aa, Escherichia coli DEC9A; identical to SEQ ID NO: 6459

SEQ ID NO: 13763 - protein, 478 aa, Escherichia coli DEC9A; identical to SEQ ID NO: 5711

SEQ ID NO: 13764 - protein, 512 aa, Escherichia coli DEC9A; identical to SEQ ID NO: 6251

SEQ ID NO: 13765 - protein, 368 aa, Escherichia coli DEC9A; identical to SEQ ID NO: 7849

SEQ ID NO: 13766 - protein, 241 aa, Escherichia coli DEC9A; identical to SEQ ID NO: 6134

SEQ ID NO: 13767 - protein, 776 aa, Escherichia coli DEC9A
MIFKNVASRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 13768 - protein, 859 aa, Escherichia coli DEC9B
MWNLLRRTRKNQKSGRDVREAGWTSLFQAVAEPFSGAWQQGVKADPEAVLSFHAVFACISLISQDIAKMRLRLMQTDAHGIRRETRRGDIARLCRRPNAQQNRIQFFELWLNAKLRHGNTVVLKIRNARGQIKELRILDWSRVEPLVADDGEVFYRITPDRNCGITEAVTVPAREVIHDRFNCFFHPLIGLPPVYAAGLAATQGHHIQENSTSFFRNGGRPSGVIEIPGSITEENAKKLKSNWDSGYTGENAGKTAILSNGAKYNPTTFSPVDAQTVEQLKMTAEIVCSVFRVPAYKIGVGQPPSSDNVEALEQQYYSQCLQTLIESIELLLDEALETGENESTEFDVTTLLRMDSERRMKTLGDAVKNTLLTPNEARKRENLPPLAGGDALYLQQQNYSLEALSRRDAREDPFASAGKTVSSQLPDGASDGNKAISETEHDAVKAMFRGDTEKMTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVNDAVANIPQPADGKSLTPDDVRPMLEQMVKEAVSHIHVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 13769 - protein, 170 aa, Escherichia coli DEC9B [sequence omitted]

SEQ ID NO: 13770 - protein, 765 aa, Escherichia coli DEC9B
MQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFLIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 13771 - protein, 230 aa, Escherichia coli DEC9B; identical to SEQ ID NO: 7855

SEQ ID NO: 13772 - protein, 747 aa, Escherichia coli DEC9B; identical to SEQ ID NO: 8868

SEQ ID NO: 13773 - protein, 266 aa, Escherichia coli DEC9B; identical to SEQ ID NO: 5772

SEQ ID NO: 13774 - protein, 161 aa, Escherichia coli DEC9B; identical to SEQ ID NO: 5769

SEQ ID NO: 13775 - protein, 221 aa, Escherichia coli DEC9B; identical to SEQ ID NO: 7859

SEQ ID NO: 13776 - protein, 351 aa, Escherichia coli DEC9B; identical to SEQ ID NO: 8799

SEQ ID NO: 13777 - protein, 230 aa, Escherichia coli DEC9B; identical to SEQ ID NO: 7861

SEQ ID NO: 13778 - protein, 593 aa, Escherichia coli DEC9B; identical to SEQ ID NO: 9013

SEQ ID NO: 13779 - protein, 746 aa, Escherichia coli DEC9B; identical to SEQ ID NO: 6296

SEQ ID NO: 13780 - protein, 193 aa, Escherichia coli DEC9B; identical to SEQ ID NO: 6300

SEQ ID NO: 13781 - protein, 243 aa, Escherichia coli DEC9B; identical to SEQ ID NO: 9157

SEQ ID NO: 13782 - protein, 816 aa, Escherichia coli DEC9B; identical to SEQ ID NO: 13717

SEQ ID NO: 13783 - protein, 430 aa, Escherichia coli DEC9B; identical to SEQ ID NO: 5758

SEQ ID NO: 13784 - protein, 331 aa, Escherichia coli DEC9B; identical to SEQ ID NO: 6456

SEQ ID NO: 13785 - protein, 760 aa, Escherichia coli DEC9B; identical to SEQ ID NO: 6322

SEQ ID NO: 13786 - protein, 191 aa, Escherichia coli DEC9B; identical to SEQ ID NO: 5748

SEQ ID NO: 13787 - protein, 203 aa, Escherichia coli DEC9B; identical to SEQ ID NO: 6414

SEQ ID NO: 13788 - protein, 361 aa, Escherichia coli DEC9B; identical to SEQ ID NO: 7868

SEQ ID NO: 13789 - protein, 224 aa, Escherichia coli DEC9B; identical to SEQ ID NO: 7869

SEQ ID NO: 13790 - protein, 851 aa, Escherichia coli DEC9B
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGGSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 13791 - protein, 232 aa, Escherichia coli DEC9B; identical to SEQ ID NO: 5747

SEQ ID NO: 13792 - protein, 229 aa, Escherichia coli DEC9B; identical to SEQ ID NO: 9369

SEQ ID NO: 13793 - protein, 729 aa, Escherichia coli DEC9B; identical to SEQ ID NO: 7878

SEQ ID NO: 13794 - protein, 213 aa, Escherichia coli DEC9B; identical to SEQ ID NO: 5744

SEQ ID NO: 13795 - protein, 203 aa, Escherichia coli DEC9B; identical to SEQ ID NO: 6347

SEQ ID NO: 13796 - protein, 565 aa, Escherichia coli DEC9B; identical to SEQ ID NO: 6492

SEQ ID NO: 13797 - protein, 207 aa, Escherichia coli DEC9B; identical to SEQ ID NO: 5743

SEQ ID NO: 13798 - protein, 539 aa, Escherichia coli DEC9B; identical to SEQ ID NO: 13733

SEQ ID NO: 13799 - protein, 700 aa, Escherichia coli DEC9B; identical to SEQ ID NO: 7945

SEQ ID NO: 13800 - protein, 774 aa, Escherichia coli DEC9B
MTPLRVFRKTTPLVNAIRLSLLPLAGLSFSAFAAQVNIAPGSLDKALNQYAAHSGITLSVDASLTRGKQSNGLHGDYDVESGLQQLLDGSGLQVKPLGNNSWTLEPALAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRSYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYGSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 13801 - protein, 111 aa, Escherichia coli DEC9B; identical to SEQ ID NO: 7885

SEQ ID NO: 13802 - protein, 118 aa, Escherichia coli DEC9B [sequence omitted]

SEQ ID NO: 13803 - protein, 673 aa, Escherichia coli DEC9B; identical to SEQ ID NO: 13737

SEQ ID NO: 13804 - protein, 826 aa, Escherichia coli DEC9B; identical to SEQ ID NO: 8836

SEQ ID NO: 13805 - protein, 224 aa, Escherichia coli DEC9B; identical to SEQ ID NO: 6435

SEQ ID NO: 13806 - protein, 631 aa, Escherichia coli DEC9B; identical to SEQ ID NO: 6430

SEQ ID NO: 13807 - protein, 162 aa, Escherichia coli DEC9B; identical to SEQ ID NO: 5896

SEQ ID NO: 13808 - protein, 363 aa, Escherichia coli DEC9B; identical to SEQ ID NO: 7893

SEQ ID NO: 13809 - protein, 274 aa, Escherichia coli DEC9B; identical to SEQ ID NO: 7895

SEQ ID NO: 13810 - protein, 250 aa, Escherichia coli DEC9B; identical to SEQ ID NO: 7896

SEQ ID NO: 13811 - protein, 373 aa, Escherichia coli DEC9B
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPVRFAIRS

SEQ ID NO: 13812 - protein, 200 aa, Escherichia coli DEC9B; identical to SEQ ID NO: 6311

SEQ ID NO: 13813 - protein, 518 aa, Escherichia coli DEC9B; identical to SEQ ID NO: 6358

SEQ ID NO: 13814 - protein, 432 aa, Escherichia coli DEC9B; identical to SEQ ID NO: 5727

SEQ ID NO: 13815 - protein, 359 aa, Escherichia coli DEC9B; identical to SEQ ID NO: 5847

SEQ ID NO: 13816 - protein, 834 aa, Escherichia coli DEC9B; identical to SEQ ID NO: 8846

SEQ ID NO: 13817 - protein, 249 aa, Escherichia coli DEC9B; identical to SEQ ID NO: 6450

SEQ ID NO: 13818 - protein, 686 aa, Escherichia coli DEC9B; identical to SEQ ID NO: 6453

SEQ ID NO: 13819 - protein, 231 aa, Escherichia coli DEC9B; identical to SEQ ID NO: 6351

SEQ ID NO: 13820 - protein, 838 aa, Escherichia coli DEC9B; identical to SEQ ID NO: 8849

SEQ ID NO: 13821 - protein, 678 aa, Escherichia coli DEC9B
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPAPVSTPAATTTAVSAPANPSAELKIYDTSSQPLSQILSQVQQDGASIVVGPLLKNNVEELLKSNTPLNMLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 13822 - protein, 386 aa, Escherichia coli DEC9B; identical to SEQ ID NO: 7908

SEQ ID NO: 13823 - protein, 843 aa, Escherichia coli DEC9B; identical to SEQ ID NO: 7909

SEQ ID NO: 13824 - protein, 243 aa, Escherichia coli DEC9B; identical to SEQ ID NO: 13759

SEQ ID NO: 13825 - protein, 208 aa, Escherichia coli DEC9B; identical to SEQ ID NO: 5717

SEQ ID NO: 13826 - protein, 614 aa, Escherichia coli DEC9B; identical to SEQ ID NO: 6303

SEQ ID NO: 13827 - protein, 446 aa, Escherichia coli DEC9B; identical to SEQ ID NO: 6459

SEQ ID NO: 13828 - protein, 478 aa, Escherichia coli DEC9B; identical to SEQ ID NO: 5711

SEQ ID NO: 13829 - protein, 512 aa, Escherichia coli DEC9B; identical to SEQ ID NO: 6251

SEQ ID NO: 13830 - protein, 241 aa, Escherichia coli DEC9B
MSNKNVNVRKSQEITFCLLAGILMFMAMMVAGRAEAGVPLGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 13831 - protein, 392 aa, Escherichia coli DEC9B
MAVKISGVLKDGTGKPVENCTIQLKARRTSSTVVVNTVASENPDEAGRYSMDVEYGQYSVILLVEGFPPSHAGTITVYEDSQPGTLNDFLGAMSEDDVRPEALRRFELMVEEAARHAEEAKKNAGEAETSARNAGISASQAEESAAHADTSAGDASESARQAAESAAAAKQSEEASSSSASAAAQKASESSQSAAEAELSKKTAESAAGNAARDATTATEKARESAESAQSAEQSRIAAEEAVNRIPTVVGPPGPKGEQGPAGPQGPKGDKGERGDTGPVGATGERGPAGDAGPAGPQGPKGDRGERGETGLTGNAGPQGPKGDTGAAGPAGPQGPKGETGAAGPVGATGPQGPKGDPGGDTNTVPSGAGETLLRQTAMAGSRIQMAHSSPD

SEQ ID NO: 13832 - protein, 776 aa, Escherichia coli DEC9B; identical to SEQ ID NO: 13767

SEQ ID NO: 13833 - protein, 784 aa, Escherichia coli DEC9B; identical to SEQ ID NO: 6283

SEQ ID NO: 13834 - protein, 784 aa, Escherichia coli DEC9C; identical to SEQ ID NO: 6283

SEQ ID NO: 13835 - protein, 170 aa, Escherichia coli DEC9C [sequence omitted]

SEQ ID NO: 13836 - protein, 765 aa, Escherichia coli DEC9C; identical to SEQ ID NO: 13770

SEQ ID NO: 13837 - protein, 230 aa, Escherichia coli DEC9C; identical to SEQ ID NO: 7855

SEQ ID NO: 13838 - protein, 747 aa, Escherichia coli DEC9C; identical to SEQ ID NO: 8868

SEQ ID NO: 13839 - protein, 266 aa, Escherichia coli DEC9C; identical to SEQ ID NO: 5772

SEQ ID NO: 13840 - protein, 161 aa, Escherichia coli DEC9C; identical to SEQ ID NO: 5769

SEQ ID NO: 13841 - protein, 221 aa, Escherichia coli DEC9C; identical to SEQ ID NO: 7859

SEQ ID NO: 13842 - protein, 351 aa, Escherichia coli DEC9C; identical to SEQ ID NO: 8799

SEQ ID NO: 13843 - protein, 223 aa, Escherichia coli DEC9C
MMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRLIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 13844 - protein, 619 aa, Escherichia coli DEC9C
MGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGTVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGRKPVPFGSLVRENSTGITSMVGDDGQVYLSGAPLSGELLVQWGDGANSRCIAHYVLPKQSLQQAVTVISAVCTHPGS

SEQ ID NO: 13845 - protein, 360 aa, Escherichia coli DEC9C; identical to SEQ ID NO: 8802

SEQ ID NO: 13846 - protein, 746 aa, Escherichia coli DEC9C; identical to SEQ ID NO: 6296

SEQ ID NO: 13847 - protein, 193 aa, Escherichia coli DEC9C; identical to SEQ ID NO: 6300

SEQ ID NO: 13848 - protein, 234 aa, Escherichia coli DEC9C
MLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALRKKAGEKVELQLQVSQQGNQLTLKNPTAYYLTIAYLGRNEKGVLPGFKTVMVAPFSTVNTNIGNYSGSQFYLGYMDDYGALRMTTLNCSGQCHLQAVEAKK

SEQ ID NO: 13849 - protein, 816 aa, Escherichia coli DEC9C; identical to SEQ ID NO: 13717

SEQ ID NO: 13850 - protein, 430 aa, Escherichia coli DEC9C; identical to SEQ ID NO: 5758

SEQ ID NO: 13851 - protein, 331 aa, Escherichia coli DEC9C; identical to SEQ ID NO: 6456

SEQ ID NO: 13852 - protein, 760 aa, Escherichia coli DEC9C; identical to SEQ ID NO: 6322

SEQ ID NO: 13853 - protein, 203 aa, Escherichia coli DEC9C; identical to SEQ ID NO: 6414

SEQ ID NO: 13854 - protein, 361 aa, Escherichia coli DEC9C; identical to SEQ ID NO: 7868

SEQ ID NO: 13855 - protein, 224 aa, Escherichia coli DEC9C; identical to SEQ ID NO: 7869

SEQ ID NO: 13856 - protein, 866 aa, Escherichia coli DEC9C
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGGSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 13857 - protein, 226 aa, Escherichia coli DEC9C; identical to SEQ ID NO: 7934

SEQ ID NO: 13858 - protein, 191 aa, Escherichia coli DEC9C; identical to SEQ ID NO: 5748

SEQ ID NO: 13859 - protein, 232 aa, Escherichia coli DEC9C; identical to SEQ ID NO: 5747

SEQ ID NO: 13860 - protein, 729 aa, Escherichia coli DEC9C; identical to SEQ ID NO: 7878

SEQ ID NO: 13861 - protein, 213 aa, Escherichia coli DEC9C; identical to SEQ ID NO: 5744

SEQ ID NO: 13862 - protein, 446 aa, Escherichia coli DEC9C; identical to SEQ ID NO: 6459

SEQ ID NO: 13863 - protein, 551 aa, Escherichia coli DEC9C
MDRRRFIKGSMAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQTLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 13864 - protein, 672 aa, Escherichia coli DEC9C; identical to SEQ ID NO: 10263

SEQ ID NO: 13865 - protein, 111 aa, Escherichia coli DEC9C; identical to SEQ ID NO: 7885

SEQ ID NO: 13866 - protein, 673 aa, Escherichia coli DEC9C; identical to SEQ ID NO: 13737

SEQ ID NO: 13867 - protein, 118 aa, Escherichia coli DEC9C [sequence omitted]

SEQ ID NO: 13868 - protein, 826 aa, Escherichia coli DEC9C; identical to SEQ ID NO: 8836

SEQ ID NO: 13869 - protein, 224 aa, Escherichia coli DEC9C; identical to SEQ ID NO: 6435

SEQ ID NO: 13870 - protein, 650 aa, Escherichia coli DEC9C; identical to SEQ ID NO: 9042

SEQ ID NO: 13871 - protein, 162 aa, Escherichia coli DEC9C; identical to SEQ ID NO: 5896

SEQ ID NO: 13872 - protein, 363 aa, Escherichia coli DEC9C; identical to SEQ ID NO: 7893

SEQ ID NO: 13873 - protein, 200 aa, Escherichia coli DEC9C; identical to SEQ ID NO: 6311

SEQ ID NO: 13874 - protein, 274 aa, Escherichia coli DEC9C; identical to SEQ ID NO: 7895

SEQ ID NO: 13875 - protein, 250 aa, Escherichia coli DEC9C; identical to SEQ ID NO: 7896

SEQ ID NO: 13876 - protein, 373 aa, Escherichia coli DEC9C; identical to SEQ ID NO: 13811

SEQ ID NO: 13877 - protein, 518 aa, Escherichia coli DEC9C; identical to SEQ ID NO: 6358

SEQ ID NO: 13878 - protein, 432 aa, Escherichia coli DEC9C; identical to SEQ ID NO: 5727

SEQ ID NO: 13879 - protein, 774 aa, Escherichia coli DEC9C; identical to SEQ ID NO: 13800

SEQ ID NO: 13880 - protein, 359 aa, Escherichia coli DEC9C; identical to SEQ ID NO: 5847

SEQ ID NO: 13881 - protein, 523 aa, Escherichia coli DEC9C; identical to SEQ ID NO: 7963

SEQ ID NO: 13882 - protein, 834 aa, Escherichia coli DEC9C; identical to SEQ ID NO: 8846

SEQ ID NO: 13883 - protein, 231 aa, Escherichia coli DEC9C; identical to SEQ ID NO: 8991

SEQ ID NO: 13884 - protein, 224 aa, Escherichia coli DEC9C
MIITLLCSFCIGQALAGGIVLQRTRVIYDASRKEAALPVANKGAETPYLLQSWVDNIDGTSRAPFIITPPLFRLEAGDDSSLRIIKTADNLPENKESLFYINVRAIPAKKKSDDVNANELTLVFKTRIKMFYRPAHLKGRVNDAWTSLEFKRSDHSLNIYNPTEYYVVFAGLAVDKTDLTSKIEYIAPGEHKQLPLPASGGKNVKWAAINDYGGSSGTETRPLQ

SEQ ID NO: 13885 - protein, 838 aa, Escherichia coli DEC9C; identical to SEQ ID NO: 8849

SEQ ID NO: 13886 - protein, 678 aa, Escherichia coli DEC9C; identical to SEQ ID NO: 13821

SEQ ID NO: 13887 - protein, 386 aa, Escherichia coli DEC9C; identical to SEQ ID NO: 7908

SEQ ID NO: 13888 - protein, 208 aa, Escherichia coli DEC9C; identical to SEQ ID NO: 5717

SEQ ID NO: 13889 - protein, 614 aa, Escherichia coli DEC9C; identical to SEQ ID NO: 6303

SEQ ID NO: 13890 - protein, 243 aa, Escherichia coli DEC9C; identical to SEQ ID NO: 13759

SEQ ID NO: 13891 - protein, 228 aa, Escherichia coli DEC9C; identical to SEQ ID NO: 6185

SEQ ID NO: 13892 - protein, 840 aa, Escherichia coli DEC9C; identical to SEQ ID NO: 8997

SEQ ID NO: 13893 - protein, 373 aa, Escherichia coli DEC9C
MAVKISGVLKDGTGKPVENCTIQLKARRTSSTVVVNTVASENPDEAGRYSMDVEYGQYSVILLVEGFPPSHAGTITVYEDSQPGTLNDFLGAMSEDDVRPEALRRFELMVEEVARHAEEAKKNAGEAETSARNAGISASQAEESAANADTSAGEASESARQAAESAASAKQSEDASSSSASAAAQKASESSQSAAEAELSRKTAESAAGNAARDATTATEKARESAESAQSAEQSRIAAEEAVNRIPTVVGPPGPKGEQGPAGPQGPKGDKGERGDTGPVGATGERGPAGDAGPAGPQGPKGDRGERGETGLTGNAGPQGPKGDTGAAGPAGPQGPKGETGAAGPVGATGPQGPKGDPGETQIRFTSGAGEHY

SEQ ID NO: 13894 - protein, 478 aa, Escherichia coli DEC9C; identical to SEQ ID NO: 5711

SEQ ID NO: 13895 - protein, 514 aa, Escherichia coli DEC9C; identical to SEQ ID NO: 9000

SEQ ID NO: 13896 - protein, 368 aa, Escherichia coli DEC9C; identical to SEQ ID NO: 7849

SEQ ID NO: 13897 - protein, 216 aa, Escherichia coli DEC9C
MAMMVAGRAEAGVPLGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 13898 - protein, 776 aa, Escherichia coli DEC9C; identical to SEQ ID NO: 13767

SEQ ID NO: 13899 - protein, 119 aa, Escherichia coli DEC9D; identical to SEQ ID NO: 6116

SEQ ID NO: 13900 - protein, 407 aa, Escherichia coli DEC9D; identical to SEQ ID NO: 10865

SEQ ID NO: 13901 - protein, 170 aa, Escherichia coli DEC9D [sequence omitted]

SEQ ID NO: 13902 - protein, 866 aa, Escherichia coli DEC9D; identical to SEQ ID NO: 7345

SEQ ID NO: 13903 - protein, 230 aa, Escherichia coli DEC9D; identical to SEQ ID NO: 7855

SEQ ID NO: 13904 - protein, 747 aa, Escherichia coli DEC9D; identical to SEQ ID NO: 8868

SEQ ID NO: 13905 - protein, 266 aa, Escherichia coli DEC9D; identical to SEQ ID NO: 5772

SEQ ID NO: 13906 - protein, 161 aa, Escherichia coli DEC9D; identical to SEQ ID NO: 5769

SEQ ID NO: 13907 - protein, 221 aa, Escherichia coli DEC9D; identical to SEQ ID NO: 7859

SEQ ID NO: 13908 - protein, 351 aa, Escherichia coli DEC9D; identical to SEQ ID NO: 8799

SEQ ID NO: 13909 - protein, 230 aa, Escherichia coli DEC9D; identical to SEQ ID NO: 7861

SEQ ID NO: 13910 - protein, 869 aa, Escherichia coli DEC9D; identical to SEQ ID NO: 8801

SEQ ID NO: 13911 - protein, 360 aa, Escherichia coli DEC9D; identical to SEQ ID NO: 8802

SEQ ID NO: 13912 - protein, 193 aa, Escherichia coli DEC9D; identical to SEQ ID NO: 6300

SEQ ID NO: 13913 - protein, 243 aa, Escherichia coli DEC9D; identical to SEQ ID NO: 9157

SEQ ID NO: 13914 - protein, 816 aa, Escherichia coli DEC9D; identical to SEQ ID NO: 13717

SEQ ID NO: 13915 - protein, 430 aa, Escherichia coli DEC9D; identical to SEQ ID NO: 5758

SEQ ID NO: 13916 - protein, 746 aa, Escherichia coli DEC9D; identical to SEQ ID NO: 6296

SEQ ID NO: 13917 - protein, 331 aa, Escherichia coli DEC9D; identical to SEQ ID NO: 6456

SEQ ID NO: 13918 - protein, 760 aa, Escherichia coli DEC9D
MENNRNFPASEFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKRPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 13919 - protein, 203 aa, Escherichia coli DEC9D; identical to SEQ ID NO: 6414

SEQ ID NO: 13920 - protein, 361 aa, Escherichia coli DEC9D; identical to SEQ ID NO: 7868

SEQ ID NO: 13921 - protein, 224 aa, Escherichia coli DEC9D; identical to SEQ ID NO: 7869

SEQ ID NO: 13922 - protein, 591 aa, Escherichia coli DEC9D
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDCLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGGSWNYSKSRGQPDADQVFALNFSLPLNLLLPRSNDSYTRKKITPG

SEQ ID NO: 13923 - protein, 229 aa, Escherichia coli DEC9D; identical to SEQ ID NO: 9369

SEQ ID NO: 13924 - protein, 191 aa, Escherichia coli DEC9D; identical to SEQ ID NO: 5748

SEQ ID NO: 13925 - protein, 232 aa, Escherichia coli DEC9D; identical to SEQ ID NO: 5747

SEQ ID NO: 13926 - protein, 729 aa, Escherichia coli DEC9D; identical to SEQ ID NO: 7878

SEQ ID NO: 13927 - protein, 213 aa, Escherichia coli DEC9D; identical to SEQ ID NO: 5744

SEQ ID NO: 13928 - protein, 203 aa, Escherichia coli DEC9D; identical to SEQ ID NO: 6347

SEQ ID NO: 13929 - protein, 565 aa, Escherichia coli DEC9D; identical to SEQ ID NO: 6492

SEQ ID NO: 13930 - protein, 207 aa, Escherichia coli DEC9D; identical to SEQ ID NO: 5743

SEQ ID NO: 13931 - protein, 539 aa, Escherichia coli DEC9D; identical to SEQ ID NO: 13733

SEQ ID NO: 13932 - protein, 700 aa, Escherichia coli DEC9D; identical to SEQ ID NO: 7945

SEQ ID NO: 13933 - protein, 118 aa, Escherichia coli DEC9D [sequence omitted]

SEQ ID NO: 13934 - protein, 111 aa, Escherichia coli DEC9D; identical to SEQ ID NO: 7885

SEQ ID NO: 13935 - protein, 673 aa, Escherichia coli DEC9D; identical to SEQ ID NO: 13737

SEQ ID NO: 13936 - protein, 826 aa, Escherichia coli DEC9D
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVLNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAASYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 13937 - protein, 224 aa, Escherichia coli DEC9D; identical to SEQ ID NO: 6435

SEQ ID NO: 13938 - protein, 631 aa, Escherichia coli DEC9D; identical to SEQ ID NO: 6430

SEQ ID NO: 13939 - protein, 162 aa, Escherichia coli DEC9D; identical to SEQ ID NO: 5896

SEQ ID NO: 13940 - protein, 363 aa, Escherichia coli DEC9D; identical to SEQ ID NO: 7893

SEQ ID NO: 13941 - protein, 518 aa, Escherichia coli DEC9D; identical to SEQ ID NO: 6358

SEQ ID NO: 13942 - protein, 200 aa, Escherichia coli DEC9D; identical to SEQ ID NO: 6311

SEQ ID NO: 13943 - protein, 274 aa, Escherichia coli DEC9D; identical to SEQ ID NO: 7895

SEQ ID NO: 13944 - protein, 250 aa, Escherichia coli DEC9D; identical to SEQ ID NO: 7896

SEQ ID NO: 13945 - protein, 373 aa, Escherichia coli DEC9D; identical to SEQ ID NO: 13811

SEQ ID NO: 13946 - protein, 432 aa, Escherichia coli DEC9D; identical to SEQ ID NO: 5727

SEQ ID NO: 13947 - protein, 359 aa, Escherichia coli DEC9D; identical to SEQ ID NO: 5847

SEQ ID NO: 13948 - protein, 686 aa, Escherichia coli DEC9D; identical to SEQ ID NO: 6453

SEQ ID NO: 13949 - protein, 834 aa, Escherichia coli DEC9D; identical to SEQ ID NO: 8846

SEQ ID NO: 13950 - protein, 249 aa, Escherichia coli DEC9D; identical to SEQ ID NO: 6450

SEQ ID NO: 13951 - protein, 231 aa, Escherichia coli DEC9D; identical to SEQ ID NO: 6351

SEQ ID NO: 13952 - protein, 838 aa, Escherichia coli DEC9D; identical to SEQ ID NO: 8849

SEQ ID NO: 13953 - protein, 678 aa, Escherichia coli DEC9D; identical to SEQ ID NO: 6353

SEQ ID NO: 13954 - protein, 412 aa, Escherichia coli DEC9D; identical to SEQ ID NO: 6495

SEQ ID NO: 13955 - protein, 843 aa, Escherichia coli DEC9D
MHWMHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYNALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVCSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 13956 - protein, 228 aa, Escherichia coli DEC9D; identical to SEQ ID NO: 6185

SEQ ID NO: 13957 - protein, 243 aa, Escherichia coli DEC9D; identical to SEQ ID NO: 13759

SEQ ID NO: 13958 - protein, 208 aa, Escherichia coli DEC9D; identical to SEQ ID NO: 5717

SEQ ID NO: 13959 - protein, 614 aa, Escherichia coli DEC9D; identical to SEQ ID NO: 6303

SEQ ID NO: 13960 - protein, 446 aa, Escherichia coli DEC9D; identical to SEQ ID NO: 6459

SEQ ID NO: 13961 - protein, 478 aa, Escherichia coli DEC9D; identical to SEQ ID NO: 5711

SEQ ID NO: 13962 - protein, 512 aa, Escherichia coli DEC9D; identical to SEQ ID NO: 6251

SEQ ID NO: 13963 - protein, 368 aa, Escherichia coli DEC9D; identical to SEQ ID NO: 7849

SEQ ID NO: 13964 - protein, 241 aa, Escherichia coli DEC9D; identical to SEQ ID NO: 13830

SEQ ID NO: 13965 - protein, 776 aa, Escherichia coli DEC9D; identical to SEQ ID NO: 13767

SEQ ID NO: 13966 - protein, 784 aa, Escherichia coli DEC9D; identical to SEQ ID NO: 6283

SEQ ID NO: 13967 - protein, 784 aa, Escherichia coli DEC9E; identical to SEQ ID NO: 6283

SEQ ID NO: 13968 - protein, 170 aa, Escherichia coli DEC9E [sequence omitted]

SEQ ID NO: 13969 - protein, 765 aa, Escherichia coli DEC9E; identical to SEQ ID NO: 8790

SEQ ID NO: 13970 - protein, 230 aa, Escherichia coli DEC9E; identical to SEQ ID NO: 7855

SEQ ID NO: 13971 - protein, 747 aa, Escherichia coli DEC9E; identical to SEQ ID NO: 8868

SEQ ID NO: 13972 - protein, 266 aa, Escherichia coli DEC9E; identical to SEQ ID NO: 5772

SEQ ID NO: 13973 - protein, 161 aa, Escherichia coli DEC9E; identical to SEQ ID NO: 5769

SEQ ID NO: 13974 - protein, 221 aa, Escherichia coli DEC9E; identical to SEQ ID NO: 7859

SEQ ID NO: 13975 - protein, 351 aa, Escherichia coli DEC9E; identical to SEQ ID NO: 8799

SEQ ID NO: 13976 - protein, 230 aa, Escherichia coli DEC9E; identical to SEQ ID NO: 7861

SEQ ID NO: 13977 - protein, 593 aa, Escherichia coli DEC9E; identical to SEQ ID NO: 9013

SEQ ID NO: 13978 - protein, 365 aa, Escherichia coli DEC9E; identical to SEQ ID NO: 7354

SEQ ID NO: 13979 - protein, 193 aa, Escherichia coli DEC9E; identical to SEQ ID NO: 6300

SEQ ID NO: 13980 - protein, 746 aa, Escherichia coli DEC9E; identical to SEQ ID NO: 6296

SEQ ID NO: 13981 - protein, 243 aa, Escherichia coli DEC9E; identical to SEQ ID NO: 9157

SEQ ID NO: 13982 - protein, 816 aa, Escherichia coli DEC9E; identical to SEQ ID NO: 13717

SEQ ID NO: 13983 - protein, 430 aa, Escherichia coli DEC9E; identical to SEQ ID NO: 5758

SEQ ID NO: 13984 - protein, 361 aa, Escherichia coli DEC9E; identical to SEQ ID NO: 7868

SEQ ID NO: 13985 - protein, 224 aa, Escherichia coli DEC9E; identical to SEQ ID NO: 7869

SEQ ID NO: 13986 - protein, 591 aa, Escherichia coli DEC9E; identical to SEQ ID NO: 7870

SEQ ID NO: 13987 - protein, 130 aa, Escherichia coli DEC9E; identical to SEQ ID NO: 8814

SEQ ID NO: 13988 - protein, 331 aa, Escherichia coli DEC9E; identical to SEQ ID NO: 6456

SEQ ID NO: 13989 - protein, 660 aa, Escherichia coli DEC9E
MGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 13990 - protein, 191 aa, Escherichia coli DEC9E; identical to SEQ ID NO: 5748

SEQ ID NO: 13991 - protein, 203 aa, Escherichia coli DEC9E; identical to SEQ ID NO: 6414

SEQ ID NO: 13992 - protein, 232 aa, Escherichia coli DEC9E; identical to SEQ ID NO: 5747

SEQ ID NO: 13993 - protein, 729 aa, Escherichia coli DEC9E; identical to SEQ ID NO: 7878

SEQ ID NO: 13994 - protein, 213 aa, Escherichia coli DEC9E; identical to SEQ ID NO: 5744

SEQ ID NO: 13995 - protein, 261 aa, Escherichia coli DEC9E
MDVEYGQYSVILLVEGFPPSHVGTITVYEDSQPGTLNDFLGAMTEDDARPEALRRFEQMVEEAARHAEEAKKNAGEAETSARNAGISASKAEASAANADTSAEDASESARQAAESAASAKKSEEASSSSASEAAQKASESLQSATDAELSKKTAESAAGNASRDATTATEKARESAESAQSAEQSRIAAEEAVNRIPTVVGPPGPKGDPGPAGPQGPKGDKGERGDTGPAGATGERGPAGDAGPAGPQGPKGDRGNGERPV

SEQ ID NO: 13996 - protein, 405 aa, Escherichia coli DEC9E; identical to SEQ ID NO: 9167

SEQ ID NO: 13997 - protein, 446 aa, Escherichia coli DEC9E; identical to SEQ ID NO: 6459

SEQ ID NO: 13998 - protein, 203 aa, Escherichia coli DEC9E; identical to SEQ ID NO: 6347

SEQ ID NO: 13999 - protein, 565 aa, Escherichia coli DEC9E; identical to SEQ ID NO: 6492

SEQ ID NO: 14000 - protein, 207 aa, Escherichia coli DEC9E; identical to SEQ ID NO: 5743

SEQ ID NO: 14001 - protein, 539 aa, Escherichia coli DEC9E; identical to SEQ ID NO: 13733

SEQ ID NO: 14002 - protein, 700 aa, Escherichia coli DEC9E; identical to SEQ ID NO: 7945

SEQ ID NO: 14003 - protein, 111 aa, Escherichia coli DEC9E; identical to SEQ ID NO: 7885

SEQ ID NO: 14004 - protein, 118 aa, Escherichia coli DEC9E [sequence omitted]

SEQ ID NO: 14005 - protein, 673 aa, Escherichia coli DEC9E; identical to SEQ ID NO: 13737

SEQ ID NO: 14006 - protein, 826 aa, Escherichia coli DEC9E
MLRMTPLASAIVALLLGIEAYAAEETFDTHFMIGGMKDQQVANIRLDDNQPLPGQYDIDIYVNKQWSGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAASYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 14007 - protein, 224 aa, Escherichia coli DEC9E; identical to SEQ ID NO: 6435

SEQ ID NO: 14008 - protein, 631 aa, Escherichia coli DEC9E; identical to SEQ ID NO: 6430

SEQ ID NO: 14009 - protein, 162 aa, Escherichia coli DEC9E; identical to SEQ ID NO: 5896

SEQ ID NO: 14010 - protein, 363 aa, Escherichia coli DEC9E; identical to SEQ ID NO: 7893

SEQ ID NO: 14011 - protein, 250 aa, Escherichia coli DEC9E; identical to SEQ ID NO: 7896

SEQ ID NO: 14012 - protein, 881 aa, Escherichia coli DEC9E; identical to SEQ ID NO: 13746

SEQ ID NO: 14013 - protein, 200 aa, Escherichia coli DEC9E; identical to SEQ ID NO: 6311

SEQ ID NO: 14014 - protein, 274 aa, Escherichia coli DEC9E; identical to SEQ ID NO: 7895

SEQ ID NO: 14015 - protein, 472 aa, Escherichia coli DEC9E; identical to SEQ ID NO: 5729

SEQ ID NO: 14016 - protein, 432 aa, Escherichia coli DEC9E; identical to SEQ ID NO: 5727

SEQ ID NO: 14017 - protein, 359 aa, Escherichia coli DEC9E; identical to SEQ ID NO: 5847

SEQ ID NO: 14018 - protein, 774 aa, Escherichia coli DEC9E; identical to SEQ ID NO: 13750

SEQ ID NO: 14019 - protein, 686 aa, Escherichia coli DEC9E; identical to SEQ ID NO: 6453

SEQ ID NO: 14020 - protein, 834 aa, Escherichia coli DEC9E; identical to SEQ ID NO: 8846

SEQ ID NO: 14021 - protein, 249 aa, Escherichia coli DEC9E; identical to SEQ ID NO: 6450

SEQ ID NO: 14022 - protein, 231 aa, Escherichia coli DEC9E; identical to SEQ ID NO: 6351

SEQ ID NO: 14023 - protein, 838 aa, Escherichia coli DEC9E; identical to SEQ ID NO: 8849

SEQ ID NO: 14024 - protein, 678 aa, Escherichia coli DEC9E; identical to SEQ ID NO: 13756

SEQ ID NO: 14025 - protein, 386 aa, Escherichia coli DEC9E; identical to SEQ ID NO: 7908

SEQ ID NO: 14026 - protein, 614 aa, Escherichia coli DEC9E; identical to SEQ ID NO: 6303

SEQ ID NO: 14027 - protein, 208 aa, Escherichia coli DEC9E; identical to SEQ ID NO: 5717

SEQ ID NO: 14028 - protein, 130 aa, Escherichia coli DEC9E; identical to SEQ ID NO: 9060

SEQ ID NO: 14029 - protein, 843 aa, Escherichia coli DEC9E; identical to SEQ ID NO: 7909

SEQ ID NO: 14030 - protein, 478 aa, Escherichia coli DEC9E; identical to SEQ ID NO: 5711

SEQ ID NO: 14031 - protein, 514 aa, Escherichia coli DEC9E
MCNEKNKFFYFTALFCCSAQAAPSSLEKRLGKNEYFIITKSSPVRAILNDFAANYSIPVFISNSVNDDFSGEIKNEKPMKVLEKLSRLYHLTWYYDENILYIYKTNEISRSIITPTYLDIDSLLKYLRDTISVNKNSCNVRKITTFNSIEVRGVPECIKYITSLSESLDKEAQSKAKNKDVVRVFKLNYASATDITYKYRDQNVVVPGVVSILKTMASNGSLPSTGKGAVERNGNLFDNSVKISADPRLNAVVVKDREITMDIYRQLISELDIEQRQIEISVSIIDVDANDLQQLGVNWSGTLNAGQGSIAFNSSTAQANLSSSVISNANNFMIRVNALQQNSKAKILSQPSIITLNNMQAILDKNVTFYTKVSGEKVASLESITSGTLLRVTPRILDDNSNSLTGKRRERVRLLLDIQDGNQSTNQSNAQDASSILPEVQNSEMTTEATLSAGESLLLGGFIQDKESSSKDGIPLLSDIPVIGNLFSSTTKQKHSVVRLFLIKATPIKSASSE

SEQ ID NO: 14032 - protein, 368 aa, Escherichia coli DEC9E; identical to SEQ ID NO: 7849

SEQ ID NO: 14033 - protein, 216 aa, Escherichia coli DEC9E; identical to SEQ ID NO: 13480

SEQ ID NO: 14034 - protein, 776 aa, Escherichia coli DEC9E; identical to SEQ ID NO: 13767

SEQ ID NO: 14035 - protein, 878 aa, Escherichia coli E101
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 14036 - protein, 241 aa, Escherichia coli E101; identical to SEQ ID NO: 6134

SEQ ID NO: 14037 - protein, 368 aa, Escherichia coli E101
MNKTITALAIIMASFAANASVLPETPVPFKSGTGAIDNDTVYIGLGSAGTAWYKLDTQAKDKKWTALAAFPGGPRDQATSAFIDGNLYVFGGIGKNSKGLTQVFNDVHKYNPKTNSWVKLMSHAPMGMAGHVTFVHNGKAYVTGGVNQNIFNGYFEDLNEAGKDSATIDKINAHYFDKKAEDYFFNKFLLSFDPSTQQWSYAGESPWYGTAGAAVVNKGDKTWLINGEAKPGLRTDAVFELDFTGNNLKWNRLAPVSSPDGVAGGFAGISNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 14038 - protein, 478 aa, Escherichia coli E101; identical to SEQ ID NO: 5711

SEQ ID NO: 14039 - protein, 237 aa, Escherichia coli E101; identical to SEQ ID NO: 6384

SEQ ID NO: 14040 - protein, 446 aa, Escherichia coli E101; identical to SEQ ID NO: 6459

SEQ ID NO: 14041 - protein, 102 aa, Escherichia coli E101
MKKVLALVVAAAMGLSSAAFAAETATTPAPTATTTKAAPAKTTHHKKQHKAAPAQKAQAAKKHHKNAKAEQKAPEQKAQAAKKHAKKHSHQQPAKPAAQPAA

SEQ ID NO: 14042 - protein, 236 aa, Escherichia coli E101; identical to SEQ ID NO: 7814

SEQ ID NO: 14043 - protein, 883 aa, Escherichia coli E101
MTAFRAAFKAYRMHQVLLLPRFVRLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLQDRLVDASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDIYQTTVPPGPFTIDDINSAANGGDLQVTIKEADGSIQTLYVPYSSVPVLQRAGYTRYALAMGEYRSGNNLQSSPKFIQGSLMHGLEENWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPLSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 14044 - protein, 359 aa, Escherichia coli E101
MVVTGLLAANVAHAAEVYNKDGNKLDLYGKVTALRYFTDDTRDDGDKTYARLGFKGETQINDQMIGFGHWEYDFKGYNDEANGSRGNKTRLAYAGLKISEFGSLDYGRNYGVGYDIGSWTDMLPEFGGDTWSQKDVFMTYRTTGVATYRNYDFFGLIEGLNFAAQYQGKNERTDNSHLYGADYTRANGDGFGISSTYVYDGFGIGAVYTKSDRTNAQERAAANPLNASGKNAELWATGIKYDANNIYFAANYAETLNMTTYGDGYISNKAQSFEVVAQYQFDFGLRPSLAYLKSKGRDLGRYGDQDMIEYIDVGATYFFNKNMSTYVDYKINLIDESDFTRAVDIRTDNIVATGITYQF

SEQ ID NO: 14045 - protein, 700 aa, Escherichia coli E101
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEANSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGMNIAWRFE

SEQ ID NO: 14046 - protein, 203 aa, Escherichia coli E101; identical to SEQ ID NO: 6414

SEQ ID NO: 14047 - protein, 362 aa, Escherichia coli E101; identical to SEQ ID NO: 5754

SEQ ID NO: 14048 - protein, 233 aa, Escherichia coli E101
MKTCITKGIVTVSLTAILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIDGKVVKNQMISPFDKYQFSLPKGAKNSSVTYRTINDYGAETPQLNCKS

SEQ ID NO: 14049 - protein, 866 aa, Escherichia coli E101
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACALLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPINLLLPRSNDSYTSKKNYAWMTSNTSIDNEGHTTQNLGLTETLLDDGNLSYSVQQGYNSEGKTANGSASMDYKGAFADARVGYNYSDNGSQQQLNYALSGSLVTHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGVQANSGIIDDDGSLYMAGLPAKGTITVRWGEAPDQICHISYELTEQQINSAITRMDAICR

SEQ ID NO: 14050 - protein, 229 aa, Escherichia coli E101
MALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRSTRNSQGVQLTNPTPYYINLIQVSVNGKALSNVGVVPPKSQRQTSWCQAIAPCHVAWRAINDYGGLSAKKEQNLP

SEQ ID NO: 14051 - protein, 229 aa, Escherichia coli E101
MKSVLLLLTVLFVQSVEAGIMPASSRIIYRDGDREKTLMLVNTNDYPVLVQSWVDNGEGSPEAASPPFVVLPPVFRLAARRTQGLRIIYNHDPLPQDRESAFWLNLYEMPPETPHQDPTHLTLAMNTQLKIFYRPKSVTMTPEEAMRKISWHLVNNGSSSYIELNNPTPLNISFTSISIGATKVEQESDMMIKPFSQRRYWLASKNDSGIVTATYLDDNGAQIKQQLAQ

SEQ ID NO: 14052 - protein, 840 aa, Escherichia coli E101
MNKSVVSISAAMLVLLCQPVMGSEISPATPSDEDNYTFDPQLFRGSRFSQSSLAKLTARESVAPGNYKMDIYTNNKLSGSWNVTFKEATDGRVLPCLTPEVADAIGLKTGEDKGEKDPVCTFAKELAPGITSQTQLSQLRLDLSVPQSQLISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDFTWQHGLTNTLTFNSGSRIADGYQALMLGGVYGSTLGAFGANLTWSHARVPESEAQSGWMSQLTWSKTFQPTSTTVSLAGYRYSTSGYRDLADVLGERQAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTTVGLNASKGQDYWQASGNVQGAMAVHGGGVTFGPYLGETFALVEAKGAEGAKVYNSSQLEINDSGYALVPAVTPYRYNRISLDPQGMDGDAELVDSEKQVAPVAGAAVKVVFRTRPGKALLIKSHMADGSELPMGADVLDENNTVVGIAGQGGQIYLRTEQTKGHLSVRWGEGANDSCQLPFDISGKDSNSPIIRLNETCQS

SEQ ID NO: 14053 - protein, 233 aa, Escherichia coli E101
MNIFAYLLVLVFSMSMSSSAFASVVMTGTRIIFPGDAKEKTIQLRNTSDQPYIINIHVEDERGSDKNVPFMPTPQTFRMEAAAGQALRLLYTGNNLPQDRESVFWFSFSQLPYLNKNDKSQNQLILALTNRVKIFYRPSSIVGKSSDAPKNLTYQVKQNRIEVTNPTGYYVTIRAAELLNNGKKIPLANSVMIAPQSTTEWTLRSGISVARGALIHLVTVNDYGVNVTSEHAL

SEQ ID NO: 14054 - protein, 191 aa, Escherichia coli E101; identical to SEQ ID NO: 5748

SEQ ID NO: 14055 - protein, 232 aa, Escherichia coli E101; identical to SEQ ID NO: 5747

SEQ ID NO: 14056 - protein, 729 aa, Escherichia coli E101; identical to SEQ ID NO: 5745

SEQ ID NO: 14057 - protein, 213 aa, Escherichia coli E101; identical to SEQ ID NO: 5744

SEQ ID NO: 14058 - protein, 678 aa, Escherichia coli E101
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRLEKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 14059 - protein, 838 aa, Escherichia coli E101
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 14060 - protein, 231 aa, Escherichia coli E101
MSKRTFAVIITLLCSFCIGQALAGGIVLQRTRVIYDASRKEAALPVANKGAETPYLLQSWVDNIDGTSRAPFIITPPLFRLEAGDDSSLRIIKTADNLPENKESLFYINVRAIPAKKKSDDVNANELTLVFKTRIKMFYRPAHLKGRVSDAWKSLEFKRSDHSLNIYNPTEYYVVFAGLAVDKADLTSKIEYIAPGEHKQLPLPASGGKNVKWAAINDYGGSSGTETRPLQ

SEQ ID NO: 14061 - protein, 713 aa, Escherichia coli E101
MAKFTPSFSGIKGRALFSLIFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQDSYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 14062 - protein, 686 aa, Escherichia coli E101; identical to SEQ ID NO: 6339

SEQ ID NO: 14063 - protein, 660 aa, Escherichia coli E101
MSRPQFTSLRLSLLALAVSATLPTLAFATETMTVTATGNARSSFEAPMMVSVIDTSAPENQTATSATDLLRHVPGITLDGTGRTNGQDVNMRGYDHRGVLVLIDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDELTLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 14064 - protein, 402 aa, Escherichia coli E101
MLIPSVQAAKPQKVTLMVDDVPVAQVLQALAEQEKLNLVVSPDVSGTVSLHLTDVPWKQALQTVVKSAGLITRQEGNILSVHSIAWQNDNIARQEAEQARAQANLPLENRNITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 14065 - protein, 826 aa, Escherichia coli E101
MLRMTPLASAIVALLLGIEAYAAEETFDTHFMIGGMKDQQVANIRLDDNQPLPGQYDIDIYVNKQWRGKYEIIVKDNPQETCLSREIIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICR

SEQ ID NO: 14066 - protein, 224 aa, Escherichia coli E101
MKGLLSLLIFSLVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWHLTIIDDHGNYISDKI

SEQ ID NO: 14067 - protein, 659 aa, Escherichia coli E101
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFFGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 14068 - protein, 432 aa, Escherichia coli E101; identical to SEQ ID NO: 5727

SEQ ID NO: 14069 - protein, 567 aa, Escherichia coli E101
MKIKLRITIILISVLCIFNGLLTPGAYAAAANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGGGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 14070 - protein, 816 aa, Escherichia coli E101
MLRTTRWVAAIIFLYSFPGYAEETFDTHFMIGGMKGEKVSEYHFDNKQPLPGNYELDFYVNNQWRGKQDITIPESPVKPCLPKVLLTKLGVKTGNLNTEDNCILLDEAVHGGQYQWDISEHRLNLTVPQAYINELERGYVPPESWDRGIDAFYTSYNLSQYRSYDSNNNSHTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYTIYQKEVPPGPFTIADLQLSGSGSDLDVSIKEADGSVRSFLVPYSSVPNMLQPGISNFDFIAGRSQIYGVKNQEDFLEANYIYGLNNLLTLYGGTILSDNYNAITLGNGWNTPLGAISFDATRSSSKLNNDTRHEGTSYQVAYNKYLLQTATHFSVAAWRYASQDYRTFSDHLYENDKINHQSDYDDFYDIGRKNSLSANIMQPLSNNLGNVSLSALWRNYWGRSGNAKDYQFSYSNNWQHISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPIATIDGSYSHSKNAWQSGGSISSGLVVWPGGINITNQLSDTFAILDAPGLEGAHINGQKYNRTNNKGQVVYDLMIPHRENHLVLDTANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 14071 - protein, 227 aa, Escherichia coli E101; identical to SEQ ID NO: 8084

SEQ ID NO: 14072 - protein, 784 aa, Escherichia coli E101
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWQHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 14073 - protein, 241 aa, Escherichia coli E101
MFPLVKKTVSALFVSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRPSGLQGEPAEAPAKITWKLNNAQLQANNPTPYYVSFNEVKLESGGKTYNVNSSMVAPFSQASFGVTGLPGSVSSGKVVFKAINDFGGNIDGSATF

SEQ ID NO: 14074 - protein, 731 aa, Escherichia coli E101
MARSKTAQPKHSLRKIAVVVATAVSGMSVYAQAAVEPKEDTITVTAAPAPQESAWGPAATIAAKHSATATKTDTPIEKTPQSISVVTREEMDIKQPATVKEALDYTPSVFSTRGSSTTYDVVSIRGFTTPSTVNTNQYLDGLKLQGDNYSEASIDPYFLERVELLRGPVSVLYGKSHPGGVVSMVSKRPSTDPIKEIQFKMGTDNLWQTGFDFSDAIDDDGVWSYRLTGLGRSQDAQQKYAKTTRYAVAPSFSWRPDDKTDLTFLSNFQSDPDAGYYGWLPRQGTVVPYQDANGSWHKLPTDFNEGEKDNKMSRRQQLIGYSFAHEFNDTFTVRQNLRYTRIHTLYDAVYGNSYIAPAQISRAYVRSDEDLNSFTVDTQLQSNFATGAVAHTLLTGVDYLRMRNDIDANYGTADPISMQDPQYGNANININFPYAVINRQEQTGLYIQDQSEWNKWVLTLGGRYDFAKTSTYTRSTSSLDEINDQQFTWRGGINYLFDNGISPYFSYSESFEPVSGATKEGKPFDPSRGKQYEAGVKYVPKDTPVTVTASVFQLTKDKNLTADPSNILFSVQGGEIRSRGFEIEAKAALNANINVTAAYSYTDAEYTKDTLYKGKRPAEVPRNMASLWADYTFRETALSGLSFGAGARYFGDTSSFYTTGEKANQTFNVGGYTLVDAMIKYDLARFGMPGSSVGVNVNNLFDREYVSSCYRDYACYWGAERQVVATATFRF

SEQ ID NO: 14075 - protein, 266 aa, Escherichia coli E101
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTTGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 14076 - protein, 161 aa, Escherichia coli E101; identical to SEQ ID NO: 5769

SEQ ID NO: 14077 - protein, 879 aa, Escherichia coli E101
MPDHSLFRLRVLPCCVALAMSGSYVNAWAEDEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYQHSKSNDDDVINGDDTLKNWEWSRYYAWRALPSLKAKLGLGEDYLNSDIFDGFNYVGGSISTDDQMLPPNLRGYAPDISGVAHTTAKVTVSQMGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDITHSHTRLDKETAYGKGALDGNSFRVSYSKDFDELNSRVTFAGYRFSEENFMTMSEYLDASDSEMVRTGNDKEMYTATYNQNFRDAGVSVYLNYTRHTYWDRDEQTNYNVMLSHYFNLGSIRNMSVSMTGYRYEYDNQTDKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQATLTEGAIGYRKFSVISGQKAMAVLRLQDGSHPPFGAEVKNDNAQNVGLVDDDGNVYLAGVKPGEHMIVSWGGVAHCDIHLPDPLPADLFNGLLLPCQQTGAISSPVHNEIKPVIQEQTQQVTPTEPPVSVSAN

SEQ ID NO: 14078 - protein, 249 aa, Escherichia coli E101
MTNLFSAKTVATTLALLITATSLQAQASVTPDRTRLIFNESDKSISVTLRNNDPKMPYLAQSWMEDEQGNKISSPLTVLPPVQRIDSMMNGQVKVQGMPDINKLPADRESVFYFNVREIPPKSNKPNTLQIALQTRIKLFWRPKALENVSMKNPWQHKVTLTRSGQEFTVNNPTPYYVVISNASAQKNGNPAAGFSPMVISPKTSVPLNVKMDSVPVLTYVNDYGARMPLYFKCGGDTCQVDAEQSRKG

SEQ ID NO: 14079 - protein, 274 aa, Escherichia coli E101
MNKTAIALLALFASSVSLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVSTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 14080 - protein, 200 aa, Escherichia coli E101
MLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQRKAPDKNIVIFTHNHCLTYIAKDKRDATFKPDYLDGLVMHVEKGKVYLDGEFVNH

SEQ ID NO: 14081 - protein, 375 aa, Escherichia coli E101
MKVKVLSLLVPALLVAGAANAAEVYNKDGNKLDLYGKVDGLHYFSDDKSVDGDQTYMRLGFKGETQVTDQLTGYGQWEYQIQGNAPESENNSWTRVAFAGLKFQDIGSIDYGRNYGVVYDVTSWTDVLPEFGGDTYGSDNFMQQRGNGFATYRNTDFFGLVDGLNFAVQYQGQNGSVSGENDPDFTGHGITNNGRKALRQNGDGVGGSITYDYEGFGIGGAISSSKRTWDQNNTGLIGTGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 14082 - protein, 162 aa, Escherichia coli E101; identical to SEQ ID NO: 5896

SEQ ID NO: 14083 - protein, 828 aa, Escherichia coli E101; identical to SEQ ID NO: 6558

SEQ ID NO: 14084 - protein, 746 aa, Escherichia coli E101
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLSTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGITWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 14085 - protein, 193 aa, Escherichia coli E101; identical to SEQ ID NO: 6300

SEQ ID NO: 14086 - protein, 243 aa, Escherichia coli E101; identical to SEQ ID NO: 8524

SEQ ID NO: 14087 - protein, 758 aa, Escherichia coli E101
MNIYRLSVLSCLAMVTPPALAAEFNLNVLDKSIRDSVDISLLNQKGVVAPGDYFVSVTVNNNKISNGQQIRWQKSGDKIIPCINESLIELFGLKSDFRKKLPAIKECVDFSVFPEIIFTFDQANQQLNITIPQAWLAWHSENWTPPSTWNNGIPGFLMDYNLFASTYRPQSGSSSNNLNAYGTTGLNAGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLVAGRPRSSMSHHTEDETFISHEVSWGMLSNTSLYGGMLLAGDDYRSGALGIGQNMLWLGALSFDVTWADSHFDTQQDEQGYSYRFNYSKQVDATNSTISLAAYRFSDRHFHSYANYIDHKYNDADAQDEKQTISLSFGQPITPLNLNLYANILHQSWWNADTSTTANITAGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGAAFHRRSSTNEPRLMVSTDGVGDIPIQGNIDYTNRFGIAVVPFVSSYQPTTVAVNMNDLPDGVTVSENVVKETWTEGAIGFKSLASRAGKDLNVIISDANGHFPPLGADVR

SEQ ID NO: 14088 - protein, 430 aa, Escherichia coli E101
MKQALRVAFGFLILWASVLHAEVRIVIDSGVDSGRPIGVVPFQWAGPGAAPEDIGGIVAADLRNSGKFNPLDRARLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFNARLPATDGQVKFPAWSPYL

SEQ ID NO: 14089 - protein, 1443 aa, Escherichia coli E101
MSRFSHDDYTRAMLNLLPSGIAWSRLPDSVQHRLIRGLAQAYRQSDADACALITGAFPETADALTDEWYASLGLNDECGTQASTTDPAQARKFILAKLLSTGGQSVAYFTELAATMGYSITIREYRTPLCGFSWSGHLLSDDNRFNWTVVVAPPGDEVTTSRAYLECLFRRYAPAHTLVTFEWQSSYSAALSIAWDNITHVLSGALTADEGVVVSGGTVNVVIKSASGQRYVATVTTDSEGHWSYEMEDDDFANGWYSAYAEAAVDMPDDVTVPVRSEVINLRKIVSVRGVNLSVTELELDNDEHVAVAVNVWPENAEDRSWTVTVSDESVVSVVVNSDSSLTVCGVSEGDAVVTVTTNDGGHTATLQVSCYVPAVFDSVCASSSKALVSVADVVNCRVSFGDGYVAADQLETTTSGGWANILLPDSLADGELRTIRVRTAGSVRFRVYGYSSTAYNDLVRLRQLPAGQKSCSYLASNTPSLVSIDSGAFRFCKNATAFDSAFYRCKGLTAIPPGLFAECASATTFYQAFYECTGLTAVGDSAFAGCTGVTTFRQAFYGCTGLRAVGESVFAGCTGATTFEDTFYGCTGLSAVGDHVFAGCTSATTFYRVFYNCRELSTVGNSVFAGCASATTFLQAFYGCQALTSLGQGIFADCTGVTTFLQAFYNCRGLTALPEGMFDSCTAVTTFSNAFYGCTALTAIPEGLFDSCTGVTTFNRTFYGCAALTAIPAKLFANCTEVATFEGGFSGCSGLVTIPAGLFEKLTSVTTFDSAFYGCRALTTVGDRVFAGCTGTTTFASLFEGCTGLVTIPADVFAGCSGVRSFYRSFLGCTGLAMVPPELFADCTGATTFYTTFYRCTRLSEVPAELFSGCTGAKSFYKTFGECTGLSEVPARLFADCTGATTFEGVFSGCRGLTTIPAGLFADSASVTTFFEAFYECTGLTAIPSGLFADCVSVTTFRRTFYGCSGLRTLGDNVFAGCVSATTFEDTFYGCAGLTTVGDGVFAGCTSVTTFYRAFYGCTGLTSIGEGVFAGCTAVTTFSSAFYNCRGLTALPEGMFDSCTAVTTFSSAFYGCTALTAIPAGLFDNCVSVTTFSYAFGDCVRLKALPAGLFENCSRVTTFFRTFYGCTELVTVGERAFAGCSSASTFEGTFYDCTKLTTLGDSVFDGCTGVTSFYQTFSGCTKLTAIPAGLFDSSHGVTTFYRTFYRCAALTTVPEAVFDRCVSAGSFQDTFFGCTGLTMLPAGLFDNCNRVTSFYRTFRGCTGLKTLPEGLFDNNTAVTTFSQTFYGCTGLAVLPAGLFENCTGVTSFYQTFDGCTGLMTIPDGLFAGLASVTTFRETFNGCTGLTTVGDGLFAGCVSATTFEGTFYGCTGLESDVNDILPAEEYPQITSVYRCFYNCRSLQGSGCALIEKLPGVTSYADAFYNCVSLSDFSILSERYPVWV

SEQ ID NO: 14090 - protein, 351 aa, Escherichia coli E101; identical to SEQ ID NO: 5767

SEQ ID NO: 14091 - protein, 365 aa, Escherichia coli E101; identical to SEQ ID NO: 7931

SEQ ID NO: 14092 - protein, 869 aa, Escherichia coli E101; identical to SEQ ID NO: 6564

SEQ ID NO: 14093 - protein, 230 aa, Escherichia coli E101
MMTKIKLLMLIILYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPVQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 14094 - protein, 208 aa, Escherichia coli E101; identical to SEQ ID NO: 5717

SEQ ID NO: 14095 - protein, 614 aa, Escherichia coli E101
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAYTHGYDVVAYGNTGTQAQPDNDGFLSKTLYGALEHNFTDAWSGFVRGYGYDNRTNYDAYYSPGSPLVDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDAPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 14096 - protein, 518 aa, Escherichia coli E101; identical to SEQ ID NO: 6358

SEQ ID NO: 14097 - protein, 760 aa, Escherichia coli E101
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAARLNVMGEKTHDAGRDKVKNERYGIAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTASIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWRVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 14098 - protein, 331 aa, Escherichia coli E101; identical to SEQ ID NO: 6551

SEQ ID NO: 14099 - protein, 118 aa, Escherichia coli E101 [sequence omitted]

SEQ ID NO: 14100 - protein, 228 aa, Escherichia coli E101
MPMYLLRLFFAVTLITQMSMAMAGIVVGGTRVIFYGDKPDTTISIFNKETNLPYLLQTWVDPFNKEDKSKPPFSVIPPVSRIEPQQEKILRILKTAGELPKDRESVFWLNVKNIPPSIDKKNTNVLEIAIKTRIKLFWRPAAVKIIPEQAIKNVKWSRQGNNLIVENPNPIHINVMSVTVDDKDVSLNMIRPFEILTLPIPAGVAGKSLVWRFINDYGAISQPLKKNL

SEQ ID NO: 14101 - protein, 207 aa, Escherichia coli E101; identical to SEQ ID NO: 5743

SEQ ID NO: 14102 - protein, 565 aa, Escherichia coli E101
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPTEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPVKQKEAEPTP

SEQ ID NO: 14103 - protein, 656 aa, Escherichia coli E101
MRLKKHYLCTALSLAFTQQAVAVQESDSLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAANWKDDVHREKGAPHAAYDRYEDRTWSLASEYQWAAADNVDVVAGISYDWRDSVEAKKHEKDGSITHYDDNNQSAFNWQVMGKYHFVNEDTLALSYYDRTRFPTLKERYTTSKPAYNQIAIVNPQLKPERARGVDLTWNGAFTRDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFIEEGRNFWAGVEYTF

SEQ ID NO: 14104 - protein, 203 aa, Escherichia coli E101; identical to SEQ ID NO: 6347

SEQ ID NO: 14105 - protein, 395 aa, Escherichia coli E101
MKRKVLAMLVPALLVAGAANAAEVYNKDGNKLDLYGKVAGLHYFSDDSGSDGDMSYARIGFKGETQIADQFTGYGQWEFNIGANGPESDKGNTATRLAFAGFGFGQNGTFDYGRNYGVVYDVEAWTDMLPEFGGDTYAGADNFMNGRANSVATYRNNGFFGQVDGLNFALQYQGNNEKSGLFDQEGSGNGNGRKLAKENGDGYGMSTSYDFDFGLSLGAAYSNSDRTDNQVHKGTHNTRYGDRFDATAGGETAEAWTVGAKYDANNVYLAAMYAETRNMTGYGDADAIANKTQNFEVVAQYQFDFGLRPSIAYLQSKGKDLGGVNSDNFDSQGNHHYTNKDLVKYVDIGMTYYFNKNMSTYVDYKINLLDNDDDFYKENGIATDDIVAVGLVYQF

SEQ ID NO: 14106 - protein, 359 aa, Escherichia coli E101; identical to SEQ ID NO: 5847

SEQ ID NO: 14107 - protein, 539 aa, Escherichia coli E101; identical to SEQ ID NO: 6525

SEQ ID NO: 14108 - protein, 857 aa, Escherichia coli E101
MSRKTVSRTFSSFSISVVAVAVASTFSAHAGKFNPKFLEDVQGVGQHVDLTMFEKGQEQQLPGIYRVSVYVNEQRMETRTLEFKEATEAQRKAMGESLVPCLSRTQLAEMGVRVESFPTLNQVPAEACVPFDEIIPQASSHFDFSEQKLVLSFPQAAMHQVARGTVPESLWDEGILALLLDYSFSGSNSEYDSSGSSSSYVDDNGTVHHDDGDDTLKSDSYYLNLRSGLNLGAWRLRNYSTWSHSGGKAQWDNIGTSLSRAIVPFKAQLTMGDTATAGDIFDSVQMRGAMLASDDEMLPDSQRGFAPIVRGIAKSNAEVSIEQNGYVIYRTYVQPGAFEINDLYPTANSGDLTVIIKEADGSEQRFIQPFSSVPIFQREGHLKYSFAAGEYQAGNYDSGSPRFGQLDLIYGLPWGMTAYGGVLISNNYNAFALGIGKNFGYNGAISIDVTQAKSELNNDRDSQGQSYRFLYSKSFESGTDFRLAGYRYSTSGFYTFQEATDVRSDADSDYNRYHKRSEIQGNLTQQLGAYGSVYLNLTQQDYWNDAGKQNTVSAGYNGRIGKVSYSIAYSWNKSPEWDESDRLWSFNISVPLGRAWSNYRVTTDQDGRTNQQVGVSGTLLEDRNLSYSVQEGYASNGVGNSGNANVGYQGGSGNVNVGYSYGKDYRQLNYSVRGGVIVHSEGVTLSQPLGETMTLISVPGARNARVVNNGGVQVDWMGNAIVPYAMPYRENEISLRSDSLGDYVDVENAFQKVVPTRGAIVRARFDTRVGYRVLMTLLRSAGSPVPFGATATLITDKQNEVSSIVGEEGQLYISGMPEEGRVLIKWGNDASQQCVAPYKLSLELKQGGIIPVSANCQ

SEQ ID NO: 14109 - protein, 228 aa, Escherichia coli E101
MKSKFVALALSLFLSQSVLAGGVGLSSTRVIYDGSKKEASLTVQNKSKTEEFLIQSWVDDAAGSKKTPFIITPPLFKLDPEKNNILRIVNITPGLPQDRESVYWVNVKAIPSKSDDSENKNVLQIAVRTRIKLFYRPAGLKGDVKTAPNELRFTRNGNQLRVDNPTVFNITFNQFFANDKEIEKAGMVPAKGALNITLPAGVGSVSKIKYNAINDFGSSAEMITKNVD

SEQ ID NO: 14110 - protein, 119 aa, Escherichia coli E101
MNLSLSKGGRPASVKNRAWHYCQMAWRGVCNQKALSRLAAFSPLLLLGMGQMAHATDLLAGGKDDVKATFGADSFVIMCIYIAEIVIGVATYIRTKNLLILLGLVVVIVFTTVGLTFVS

SEQ ID NO: 14111 - protein, 236 aa, Escherichia coli E101
MNRLLIFIGLFCVFFHKIAISSETFGPYESRLIFDGDKKNITYRIDNSGKLVWLVQGWVEDVKENKTNIFNVVPSLFRVEPKSQYTARVVKNGDLPEDRESIFWIVSNSLPGGNKGDNEGRVKEDSIDAKLNLAFRYKVPMIYRPASLGNIAQKPEKLQWKKNSNGKVKLFNPTNFAVQLQYVSINGIRKDGQGITYIIAPYTGVELNLKANSGTKIKYGVINDYGAVQEYEGAVE

SEQ ID NO: 14112 - protein, 837 aa, Escherichia coli E101
MNMIGNNKKNITILLIGVSYNVYAGDYFDPSLLATDVGNYEGIDLSVFSNPGGGLEGERNVSIYINDTFYSRGVLNFKNGPSGALDPEFPIDFFDRILALKYRPVINSEIISAEDFRKSVSYSDVKFDQAISRVDISIPQAYLGQAAQLKSMPEHWDQGVTAFLMDYRLSGSWNKNEFASSENIYASSNLGFNLSGWRLRSFVNYSLYHSDMKSGSTLRDYDLGFYSTYLEKDLGNLRSTFKLGELSTPGRILDSFSYIGGSIYSNDDMLNDKLRNYTPTIRGIANSQAIVTVKQNGRIILQKNVPAGPFEINDFSPFGYAGDLFVHIKESDGQERSFIQPFSTLPEMKREGVFGYNISIGKYDNRGARESYRDIPFIYGFWSRGFSHGITSYGETIQSDNYQLIGLGSTLSLGYLGAVSGDMSVSRVKKDGDTHIGQSYGFKYSKNKIDTGTTLTLATYRYSTEDFYSFSDFASIDNSFYNSWSHKIKNRFTLDLSQSLGDFGYLSLMASQQNYWASDRNNKSVSLSHGFNVNNIYFSTSLSLEKNSGLFYDQGYNKTIGLYVSMPISNLLGAYNRSNSSLSYNMTKTDSIVNNIATLTGPIPETNAQYRVSSGWANGGRDSSHAFSINWNGDMINASAGYTHAGSARTVDYSFSGGAIMYPWGMAFTSGSVNNGAAVVDVQGISGVKVRQGGNTSLLGTSIVSSIQPYTENRIDLDPQDLPDDVTIGELSKSFIPEKGAVIRLKYDVFKGKQVIFNLKKADGSNLPFGTVVSLAGTNNTNTGIVDDDGRVYFAGVPEKGSLRASFGKDKTCDMSFNLKNNIKENQMITEFDGVCR

SEQ ID NO: 14113 - protein, 230 aa, Escherichia coli E101
MNKVVKGALAVVLSLTFCSQSMAAFVLNGTRFIYEEGKKNISFTVTNEADKTYGGQVWIDNTDQGDGIHMIPQPPFFKIGAKQKQIIRIINTDSSLPKDRESLFWLNVQEIPPKPEKNDTEGNMLAIAMNTRVKLIYRPLSIKNERKGAENKLILEQRGNETWLKNPTPYYMALTGVKVDGKDVSLSNKTLADIARFSPFSEVSLGKKISGNVSVNAINDWGGVESFTLR

SEQ ID NO: 14114 - protein, 228 aa, Escherichia coli E101
MRGVQPVNANFIKEDAGMLKKLILTILCCFLAMNTLKTAQAAVPEEGYQYNRIEHFVADAPPVVEFFSFYCPPCAAFSGRLGVTQATEKVLPAGSRVVKYHVGYMGQFGEALTEAWSVARVLGVESQVEMPLFKAVQETKSIKSKADIRQVFIDSGIPAEQFDAAMNSMVVRAMTATQIQAVKAFGVSGTPSFIVKGKYLVRNNGIASATEAEYGTAFAKVVDFLLNK

SEQ ID NO: 14115 - protein, 700 aa, Escherichia coli E110019
MKIVSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 14116 - protein, 111 aa, Escherichia coli E110019; identical to SEQ ID NO: 7885

SEQ ID NO: 14117 - protein, 539 aa, Escherichia coli E110019
MAAVCGTSGIASLFSQAAFAADSDIADGQTQRFDFAILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 14118 - protein, 236 aa, Escherichia coli E110019; identical to SEQ ID NO: 6472

SEQ ID NO: 14119 - protein, 865 aa, Escherichia coli E110019
MPRFARLTIALGLATAVFPVDAEYYFNPRFLSNDLAESVDLSAFTKGREAPPGTYRVDIYLNDEFMTSRDITFIADDNNAELIPCLSTDLLVSLGIKKIALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYYSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 14120 - protein, 678 aa, Escherichia coli E110019
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPAPVSTPAATTTAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGAMLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPVS

SEQ ID NO: 14121 - protein, 231 aa, Escherichia coli E110019; identical to SEQ ID NO: 6351

SEQ ID NO: 14122 - protein, 806 aa, Escherichia coli E110019
MLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 14123 - protein, 249 aa, Escherichia coli E110019
MRYLNTKNLIAAGVLLACMSSIAWGAIIPDRTRIIMNESDKGEALKLTNQSKNLPYLAQTWIEDTKGNKSRDFIVTVPPMVRLNPSEQIQIRMISQEKIAQLPNDRETLFYFNVREIPPKTDKKNVMQVTMQHALKLFWRPKAIELEDDGVMSYEKVEIIRRNDGSIRFNNKMPYHVTLGYIGTNGITMLPQTQSLMVTPYSHADTQFKNVPSAFQVGYINDFGGLSFYEINCPTVNNSCNVYVAKRDK

SEQ ID NO: 14124 - protein, 837 aa, Escherichia coli E110019
MEQMYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAMNAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWGASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 14125 - protein, 686 aa, Escherichia coli E110019
MFWRDITLSVWRKKTTGLKTKKRLLPLVLAAALCSSSVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 14126 - protein, 359 aa, Escherichia coli E110019
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLQSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQASNIINTMTPGDVYQTLTTRHPSAESRRYLYKVNTAQKSYRRR

SEQ ID NO: 14127 - protein, 866 aa, Escherichia coli E110019
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGEWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGSLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 14128 - protein, 246 aa, Escherichia coli E110019; identical to SEQ ID NO: 6342

SEQ ID NO: 14129 - protein, 747 aa, Escherichia coli E110019
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNSPAQVPKHMASLWAGYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 14130 - protein, 266 aa, Escherichia coli E110019; identical to SEQ ID NO: 5772

SEQ ID NO: 14131 - protein, 161 aa, Escherichia coli E110019; identical to SEQ ID NO: 5769

SEQ ID NO: 14132 - protein, 869 aa, Escherichia coli E110019
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMSCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDELIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 14133 - protein, 230 aa, Escherichia coli E110019; identical to SEQ ID NO: 7352

SEQ ID NO: 14134 - protein, 446 aa, Escherichia coli E110019; identical to SEQ ID NO: 7485

SEQ ID NO: 14135 - protein, 478 aa, Escherichia coli E110019
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFENFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 14136 - protein, 208 aa, Escherichia coli E110019; identical to SEQ ID NO: 5717

SEQ ID NO: 14137 - protein, 614 aa, Escherichia coli E110019; identical to SEQ ID NO: 7971

SEQ ID NO: 14138 - protein, 828 aa, Escherichia coli E110019
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGQYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEEQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 14139 - protein, 162 aa, Escherichia coli E110019
MKTILPAVLFAAFATTSAWAAESVQPLEKIAPYPQAEKGMKRQVIQLTPQEDESTLKVELLIGQTLEVDCNLHRLGGKLESKTLEGWGYDYYVFDKVSSPVSTMMACPDGKKEKKFVTAYLGDAGMLRYNSKLPIVVYTPDNVDVKYRVWKAEEKIDNAEVR

SEQ ID NO: 14140 - protein, 367 aa, Escherichia coli E110019; identical to SEQ ID NO: 5796

SEQ ID NO: 14141 - protein, 200 aa, Escherichia coli E110019; identical to SEQ ID NO: 6311

SEQ ID NO: 14142 - protein, 518 aa, Escherichia coli E110019; identical to SEQ ID NO: 7565

SEQ ID NO: 14143 - protein, 351 aa, Escherichia coli E110019
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAKAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 14144 - protein, 412 aa, Escherichia coli E110019; identical to SEQ ID NO: 6495

SEQ ID NO: 14145 - protein, 746 aa, Escherichia coli E110019; identical to SEQ ID NO: 6296

SEQ ID NO: 14146 - protein, 193 aa, Escherichia coli E110019; identical to SEQ ID NO: 6300

SEQ ID NO: 14147 - protein, 243 aa, Escherichia coli E110019
MSRKSCLIRLFKTTVSCKLFTAIILSVFLGQPALTYAGVVIGGTRVVYLSNDADKSISVFSKEEKIPYLIQAWVDPFNKEDKSKAPFTVIPPVSRLEPSQEKILRIIHTKGVSLPDDRESVFWLNIKNIPPSASNKATNSLEIAVKTRIKLFWRPANIRLIPEDAAPKVKWRREGRNLIAENPNPIHISVMDVIVDGHDVPLNMIRPFETLTLPLPANSAGGQMTWRFINDYGAVSDPIKMTL

SEQ ID NO: 14148 - protein, 826 aa, Escherichia coli E110019
MLRMPPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKHSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLTFGYEVNDIHGHNIGVVGQGSQLFIRTNEIPPSVNVAIDKQQGLSCTITFGKEIDESRNYICQ

SEQ ID NO: 14149 - protein, 239 aa, Escherichia coli E110019
MAAIPWRPFNLRGIKMKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPINKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWYLTIIDDHGNYISDKI

SEQ ID NO: 14150 - protein, 760 aa, Escherichia coli E110019; identical to SEQ ID NO: 6322

SEQ ID NO: 14151 - protein, 331 aa, Escherichia coli E110019; identical to SEQ ID NO: 6456

SEQ ID NO: 14152 - protein, 232 aa, Escherichia coli E110019; identical to SEQ ID NO: 5747

SEQ ID NO: 14153 - protein, 191 aa, Escherichia coli E110019; identical to SEQ ID NO: 5748

SEQ ID NO: 14154 - protein, 517 aa, Escherichia coli E110019; identical to SEQ ID NO: 6817

SEQ ID NO: 14155 - protein, 732 aa, Escherichia coli E110019; identical to SEQ ID NO: 8819

SEQ ID NO: 14156 - protein, 274 aa, Escherichia coli E110019; identical to SEQ ID NO: 8357

SEQ ID NO: 14157 - protein, 250 aa, Escherichia coli E110019; identical to SEQ ID NO: 6317

SEQ ID NO: 14158 - protein, 880 aa, Escherichia coli E110019; identical to SEQ ID NO: 10545

SEQ ID NO: 14159 - protein, 774 aa, Escherichia coli E110019; identical to SEQ ID NO: 7727

SEQ ID NO: 14160 - protein, 118 aa, Escherichia coli E110019 [sequence omitted]

SEQ ID NO: 14161 - protein, 863 aa, Escherichia coli E110019; identical to SEQ ID NO: 7730

SEQ ID NO: 14162 - protein, 241 aa, Escherichia coli E110019; identical to SEQ ID NO: 6132

SEQ ID NO: 14163 - protein, 368 aa, Escherichia coli E110019; identical to SEQ ID NO: 7728

SEQ ID NO: 14164 - protein, 230 aa, Escherichia coli E110019
MRKAILLAGLLLSTGHSWANIVINGTRVLYPENNKEVIVQLMNTGDAPALVQSWIDDGDINSTPETANVPFLLSPPVIKVNEHNGQQLRIKKLPSSLPADRESVFFLNVLDIPPRPENLQNQNTVQLAIKSRIKLFYRPAALKGTLDDAVAKLTLAAEGDRFRITNNSPFHITVANISLGKTKLLQESPMVSPFGQLTVAAKNTVKRGQTFQLMYVDDLGAYKTRTFTSQ

SEQ ID NO: 14165 - protein, 120 aa, Escherichia coli E110019
MNAVLSVQGASAPVKKKSFFSKFTRLNMLRLVRAVLPAAVLMMFFPQLAMASGSQDLMASGNSTVKATFGKDSSVVKWVVLAEVLVGAVMYMMTKNVKFLAGFAIISVFIAVGMAVVGLK

SEQ ID NO: 14166 - protein, 512 aa, Escherichia coli E110019
MKKISFFIFTALFCCSAQAAPSSLEKRLGKNEYFIITKSSPVRAILNDFAANYSIPVFISSSVNDDFSGEIKNEKPVKVLEKLSKLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQANISSSVISNASNFMIRVNALQQNSKAKILSQPSIITLNNMQAILDKNVTFYTKVSGEKVASLESITSGTLLRVTPRILDGSSNSLTGKRRERVRLLLDIQDGNQSTNQSNAQDASSTLPEVQNSEMTTEATLSAGESLLLGGFIQDKESSSKDGIPLLSDIPVIGSLFSSTVKQKHSVVRLFLIKATPIKSASSE

SEQ ID NO: 14167 - protein, 1024 aa, Escherichia coli E110019
MPTITTAQIKSTLQSAKQSAENKLHSAGQSTKDALKKAAEKTRNAGNRLILLIPKDYKGQGSSLNDLVRTADELGIEVQYDEKNGTAITKQVFGTAEKLIGLTERGVTIFAPKLDKLLQKYQKAGNKLGGSAENIGDNLGKAGGILSTFQNFLGTALSSMKIDELIKKQKSGGNVSSSEMAEASIELINQLVDTAASLNNNVNSFSQQLNTLGSVLSNTKHLNGVGNKLQNLPNLDNIGAGLDTVSGILSTISASFILSNADADTRTKAAAGVELTTKVLGNVGKGISQYIIAQRAAQGLSTSAAAAGLIASAVILAISPLSFLSIADKFKRANKIEEYSQRFKKLGYDGDSLLAAFHKATGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKKYSVERSVLITQQHWDTLIGELAGVTRNGDKTLSGKSYIDYYEEGKRLEKKTDEFQKQVFDPLKGNIDLSDSKSSTLLKFVTPLLTPGEEIRERRQSGKYEYITELLVKGVDKWTVKGVQDKGAVYDYSNLIQHASVGNNQYRGIRIESHLGDGDDKVFLSAGSANIYAGKGHDVVYYDKTDTGYLTIDGTKATEAGNYTVTRVLGGDVKVLQEVAKEQEVSVGKRTEKTQYRSYEFTHINGKNLTETDNLYSVEELIGTTRADKFFGSKFTDIFHGADGDDLIEGNDGNDRLYGDKGNDTLSGGNGDDQLYGGDGNDKLIGGAGNNYLNGGDGDDELQVQGNSLAKNVLSGGKGNDKLYGSEGADLLDGGEGNDLLKGGYGNDIYRYLSGYGHHIIDDDGGKEDKLSLADIDFRDVAFKREGNDLIMYKAEGNVLSIGHENGITFRNWFEKESGDISNHQIEQIFDKGGRIITPDSLKKALEYQQRNNKASYVYGNDALAYGSQDNLNLLINEISKIISAAGNFDVKEERTAASLLQLSGNASDFSYGRNSITLTTSA

SEQ ID NO: 14168 - protein, 816 aa, Escherichia coli E110019
MNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNISIPQAWLAWHSENWTPPSTWKEGVAGILMDYNLFASSYRPQDGSSSTNLNAYGTTGINAGAWRLRSDYQLNQTDSDDNHEQSGGISRTYLFRPLPQLGSKLTLGETDFSSNIFDGFSYTGAALASDERMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 14169 - protein, 243 aa, Escherichia coli E110019
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALRKKAGEKVELQLQVSQQGNQLPLKNPTAYYLTIAYLGRNEKGVLPGFKTVMVAPFSTVNTNTGNYSGSQFYLGYMDDYGALRMTTLNCSGQCHLQAVEAKK

SEQ ID NO: 14170 - protein, 696 aa, Escherichia coli E110019; identical to SEQ ID NO: 6320

SEQ ID NO: 14171 - protein, 203 aa, Escherichia coli E110019; identical to SEQ ID NO: 6414

SEQ ID NO: 14172 - protein, 213 aa, Escherichia coli E110019; identical to SEQ ID NO: 5744

SEQ ID NO: 14173 - protein, 673 aa, Escherichia coli E110019; identical to SEQ ID NO: 6170

SEQ ID NO: 14174 - protein, 641 aa, Escherichia coli E110019; identical to SEQ ID NO: 7667

SEQ ID NO: 14175 - protein, 565 aa, Escherichia coli E110019
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPHQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 14176 - protein, 203 aa, Escherichia coli E110019; identical to SEQ ID NO: 6347

SEQ ID NO: 14177 - protein, 224 aa, Escherichia coli E110019; identical to SEQ ID NO: 7869

SEQ ID NO: 14178 - protein, 362 aa, Escherichia coli E110019; identical to SEQ ID NO: 5809

SEQ ID NO: 14179 - protein, 226 aa, Escherichia coli E110019; identical to SEQ ID NO: 10660

SEQ ID NO: 14180 - protein, 617 aa, Escherichia coli E110019
MAEDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTFSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGIYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 14181 - protein, 432 aa, Escherichia coli E1167; identical to SEQ ID NO: 5727

SEQ ID NO: 14182 - protein, 359 aa, Escherichia coli E1167; identical to SEQ ID NO: 6332

SEQ ID NO: 14183 - protein, 686 aa, Escherichia coli E1167
MFWRDITLSVWRKKTTGLKTKKRLLPLVLAAALCSSPVQAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 14184 - protein, 837 aa, Escherichia coli E1167; identical to SEQ ID NO: 6340

SEQ ID NO: 14185 - protein, 249 aa, Escherichia coli E1167; identical to SEQ ID NO: 6450

SEQ ID NO: 14186 - protein, 231 aa, Escherichia coli E1167; identical to SEQ ID NO: 6351

SEQ ID NO: 14187 - protein, 806 aa, Escherichia coli E1167
MLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDENNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 14188 - protein, 678 aa, Escherichia coli E1167; identical to SEQ ID NO: 9900

SEQ ID NO: 14189 - protein, 871 aa, Escherichia coli E1167
MHQVLILPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSATNGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 14190 - protein, 224 aa, Escherichia coli E1167; identical to SEQ ID NO: 10987

SEQ ID NO: 14191 - protein, 111 aa, Escherichia coli E1167; identical to SEQ ID NO: 7885

SEQ ID NO: 14192 - protein, 122 aa, Escherichia coli E1167; identical to SEQ ID NO: 5737

SEQ ID NO: 14193 - protein, 404 aa, Escherichia coli E1167; identical to SEQ ID NO: 10203

SEQ ID NO: 14194 - protein, 446 aa, Escherichia coli E1167; identical to SEQ ID NO: 6459

SEQ ID NO: 14195 - protein, 237 aa, Escherichia coli E1167; identical to SEQ ID NO: 6384

SEQ ID NO: 14196 - protein, 478 aa, Escherichia coli E1167; identical to SEQ ID NO: 8471

SEQ ID NO: 14197 - protein, 368 aa, Escherichia coli E1167; identical to SEQ ID NO: 7849

SEQ ID NO: 14198 - protein, 241 aa, Escherichia coli E1167; identical to SEQ ID NO: 6134

SEQ ID NO: 14199 - protein, 878 aa, Escherichia coli E1167
MSYLNLRLYQRNTQCLHIRKHRLAGFFVRLVVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 14200 - protein, 784 aa, Escherichia coli E1167; identical to SEQ ID NO: 6283

SEQ ID NO: 14201 - protein, 866 aa, Escherichia coli E1167; identical to SEQ ID NO: 7345

SEQ ID NO: 14202 - protein, 230 aa, Escherichia coli E1167; identical to SEQ ID NO: 7855

SEQ ID NO: 14203 - protein, 747 aa, Escherichia coli E1167; identical to SEQ ID NO: 6343

SEQ ID NO: 14204 - protein, 266 aa, Escherichia coli E1167; identical to SEQ ID NO: 5772

SEQ ID NO: 14205 - protein, 161 aa, Escherichia coli E1167; identical to SEQ ID NO: 5769

SEQ ID NO: 14206 - protein, 518 aa, Escherichia coli E1167; identical to SEQ ID NO: 6358

SEQ ID NO: 14207 - protein, 880 aa, Escherichia coli E1167; identical to SEQ ID NO: 10545

SEQ ID NO: 14208 - protein, 250 aa, Escherichia coli E1167; identical to SEQ ID NO: 10481

SEQ ID NO: 14209 - protein, 274 aa, Escherichia coli E1167; identical to SEQ ID NO: 6549

SEQ ID NO: 14210 - protein, 200 aa, Escherichia coli E1167; identical to SEQ ID NO: 6311

SEQ ID NO: 14211 - protein, 367 aa, Escherichia coli E1167; identical to SEQ ID NO: 6310

SEQ ID NO: 14212 - protein, 162 aa, Escherichia coli E1167; identical to SEQ ID NO: 5896

SEQ ID NO: 14213 - protein, 828 aa, Escherichia coli E1167; identical to SEQ ID NO: 6558

SEQ ID NO: 14214 - protein, 663 aa, Escherichia coli E1167; identical to SEQ ID NO: 8669

SEQ ID NO: 14215 - protein, 224 aa, Escherichia coli E1167; identical to SEQ ID NO: 6435

SEQ ID NO: 14216 - protein, 826 aa, Escherichia coli E1167
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQTYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLTFGYEVNDIHGHNIGVVGQGSQLFIRTNEIPPSVNVAIDKQQGLSCTITFGKEIDESRNYICQ

SEQ ID NO: 14217 - protein, 700 aa, Escherichia coli E1167; identical to SEQ ID NO: 7945

SEQ ID NO: 14218 - protein, 551 aa, Escherichia coli E1167; identical to SEQ ID NO: 5742

SEQ ID NO: 14219 - protein, 207 aa, Escherichia coli E1167; identical to SEQ ID NO: 5743

SEQ ID NO: 14220 - protein, 565 aa, Escherichia coli E1167; identical to SEQ ID NO: 6492

SEQ ID NO: 14221 - protein, 203 aa, Escherichia coli E1167; identical to SEQ ID NO: 6396

SEQ ID NO: 14222 - protein, 213 aa, Escherichia coli E1167; identical to SEQ ID NO: 5744

SEQ ID NO: 14223 - protein, 729 aa, Escherichia coli E1167
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQALGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNAIHSEVEFDSKMMYVDAYVNKADGMLVGPYSNYGPGFDYVGGTGWNSGKRKVDALDLFADGIYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 14224 - protein, 232 aa, Escherichia coli E1167; identical to SEQ ID NO: 5747

SEQ ID NO: 14225 - protein, 191 aa, Escherichia coli E1167; identical to SEQ ID NO: 5748

SEQ ID NO: 14226 - protein, 517 aa, Escherichia coli E1167
MKHKLQMMKMRWLSAAVMLTLYTSSSWAFSIDDVAKQAQSLAGKGYEAPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNTDQTLSETWSYQLPANE

SEQ ID NO: 14227 - protein, 229 aa, Escherichia coli E1167; identical to SEQ ID NO: 9369

SEQ ID NO: 14228 - protein, 851 aa, Escherichia coli E1167; identical to SEQ ID NO: 8686

SEQ ID NO: 14229 - protein, 233 aa, Escherichia coli E1167; identical to SEQ ID NO: 7394

SEQ ID NO: 14230 - protein, 362 aa, Escherichia coli E1167; identical to SEQ ID NO: 5809

SEQ ID NO: 14231 - protein, 230 aa, Escherichia coli E1167; identical to SEQ ID NO: 7352

SEQ ID NO: 14232 - protein, 869 aa, Escherichia coli E1167; identical to SEQ ID NO: 10176

SEQ ID NO: 14233 - protein, 360 aa, Escherichia coli E1167; identical to SEQ ID NO: 8317

SEQ ID NO: 14234 - protein, 746 aa, Escherichia coli E1167; identical to SEQ ID NO: 6296

SEQ ID NO: 14235 - protein, 193 aa, Escherichia coli E1167; identical to SEQ ID NO: 6300

SEQ ID NO: 14236 - protein, 228 aa, Escherichia coli E1167; identical to SEQ ID NO: 6185

SEQ ID NO: 14237 - protein, 843 aa, Escherichia coli E1167; identical to SEQ ID NO: 6288

SEQ ID NO: 14238 - protein, 412 aa, Escherichia coli E1167; identical to SEQ ID NO: 6284

SEQ ID NO: 14239 - protein, 243 aa, Escherichia coli E1167; identical to SEQ ID NO: 6463

SEQ ID NO: 14240 - protein, 816 aa, Escherichia coli E1167; identical to SEQ ID NO: 6462

SEQ ID NO: 14241 - protein, 430 aa, Escherichia coli E1167; identical to SEQ ID NO: 5758

SEQ ID NO: 14242 - protein, 332 aa, Escherichia coli E1167; identical to SEQ ID NO: 6321

SEQ ID NO: 14243 - protein, 760 aa, Escherichia coli E1167; identical to SEQ ID NO: 9087

SEQ ID NO: 14244 - protein, 203 aa, Escherichia coli E1167; identical to SEQ ID NO: 6414

SEQ ID NO: 14245 - protein, 198 aa, Escherichia coli E1167; identical to SEQ ID NO: 8853

SEQ ID NO: 14246 - protein, 121 aa, Escherichia coli E1167; identical to SEQ ID NO: 6059

SEQ ID NO: 14247 - protein, 208 aa, Escherichia coli E1167; identical to SEQ ID NO: 5717

SEQ ID NO: 14248 - protein, 351 aa, Escherichia coli E1167; identical to SEQ ID NO: 5767

SEQ ID NO: 14249 - protein, 614 aa, Escherichia coli E1167; identical to SEQ ID NO: 6303

SEQ ID NO: 14250 - protein, 191 aa, Escherichia coli E128010; identical to SEQ ID NO: 5748

SEQ ID NO: 14251 - protein, 232 aa, Escherichia coli E128010; identical to SEQ ID NO: 5747

SEQ ID NO: 14252 - protein, 51 aa, Escherichia coli E128010
MDLFTRYQVTKNFSLQGNVNNLFDKTYDTNVEGSIVYGAPRNFSITGTYQF

SEQ ID NO: 14253 - protein, 672 aa, Escherichia coli E128010
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAE

SEQ ID NO: 14254 - protein, 213 aa, Escherichia coli E128010; identical to SEQ ID NO: 5744

SEQ ID NO: 14255 - protein, 539 aa, Escherichia coli E128010; identical to SEQ ID NO: 6525

SEQ ID NO: 14256 - protein, 700 aa, Escherichia coli E128010; identical to SEQ ID NO: 9243

SEQ ID NO: 14257 - protein, 111 aa, Escherichia coli E128010; identical to SEQ ID NO: 8460

SEQ ID NO: 14258 - protein, 462 aa, Escherichia coli E128010
MAASPNSFTAAHTINGSQQVAVIESKGDKTTIESVTLKDISKYIKDDIGFSYQGYFRSGWGTGNHGSPQTYAAGSLGRFGNEMSGWFDLTLNQRVYNQDGKTANAVVTYDGNVGEQYNDAWFGDSANENIMQFSDIYLTTRGFLPFAPEADFWVGKHKLPQYEIQMLDWKTLTTDVAAGVGIENWALGVGLFDMSLSRDDVDVYSRDFSRTSQMNTNSVDVRYRNIPLWDDATLSLMAKYSAPNKTDQQQDNENDNSYFEMKDSWMLTSVLRQNLQRDTFNEFTLQVANNSYASSFASFSDASNTMAHGRYYYGDHTNGIAWRLISQGEMYLTDNIIMANALVYSHGEDVYSYESGAHSDFDSIRTVIRPAWIWNTWNQTGLELGWFKQQNKTQQGVTLNESAYKTTLWHALKVGESILGSRPEIRFYGTYINILDNELSNFKFNENSKDEFMAGIQAEVWW

SEQ ID NO: 14259 - protein, 236 aa, Escherichia coli E128010; identical to SEQ ID NO: 7814

SEQ ID NO: 14260 - protein, 241 aa, Escherichia coli E128010; identical to SEQ ID NO: 6143

SEQ ID NO: 14261 - protein, 856 aa, Escherichia coli E128010; identical to SEQ ID NO: 9540

SEQ ID NO: 14262 - protein, 512 aa, Escherichia coli E128010; identical to SEQ ID NO: 6251

SEQ ID NO: 14263 - protein, 834 aa, Escherichia coli E128010
MYKKLKLTTISELIKNIYCSLSVLIIGCASAYAVGFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQVGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASDSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 14264 - protein, 249 aa, Escherichia coli E128010; identical to SEQ ID NO: 6450

SEQ ID NO: 14265 - protein, 199 aa, Escherichia coli E128010; identical to SEQ ID NO: 7966

SEQ ID NO: 14266 - protein, 838 aa, Escherichia coli E128010; identical to SEQ ID NO: 9266

SEQ ID NO: 14267 - protein, 662 aa, Escherichia coli E128010; identical to SEQ ID NO: 8481

SEQ ID NO: 14268 - protein, 386 aa, Escherichia coli E128010; identical to SEQ ID NO: 7908

SEQ ID NO: 14269 - protein, 196 aa, Escherichia coli E128010
NFNSFKFKGGVLKTDENMYPYSEKTYSPIVKGSAKTQAKVEFFQDGVKIYSSIVPPGDFSISDYILSGSNSDLYVKVIEENGSIQEFIVPFTYPAVAVREGFTYYEIAMGETQQSNDYFTQLSFTRGLPYDFTVLTSLEYSGFYRSLEIGLGKMLGNLGALSLIYGQSNFSKSDNSKNKKWDIRYNKNIPDLNTYL

SEQ ID NO: 14270 - protein, 360 aa, Escherichia coli E128010; identical to SEQ ID NO: 6645

SEQ ID NO: 14271 - protein, 207 aa, Escherichia coli E128010; identical to SEQ ID NO: 5743

SEQ ID NO: 14272 - protein, 203 aa, Escherichia coli E128010; identical to SEQ ID NO: 6347

SEQ ID NO: 14273 - protein, 861 aa, Escherichia coli E128010; identical to SEQ ID NO: 9768

SEQ ID NO: 14274 - protein, 227 aa, Escherichia coli E128010
MSAQASVTPDRTRLIFNESDKSISVTLRNNDPKLPYLAQSWIEDEKGNKISSPLTVLPPVQRIDSMMNGQVKVQGMPDINKLPADRESLFYFNVREIPPKSNKANTLQIALQTRIKLFWRPKALENVSMKNPWQYKVTLTRNGQEFTVNNPTPYYVIFSNASTQKNGNPAAGFSPIVMSPKTSAPLNVKMGSVPVLTYVNDYGARMPLFFTCNGNSCQVDEEQSRKG

SEQ ID NO: 14275 - protein, 274 aa, Escherichia coli E128010; identical to SEQ ID NO: 8357

SEQ ID NO: 14276 - protein, 823 aa, Escherichia coli E128010
MTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGRSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDIYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRFGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 14277 - protein, 224 aa, Escherichia coli E128010; identical to SEQ ID NO: 6435

SEQ ID NO: 14278 - protein, 641 aa, Escherichia coli E128010; identical to SEQ ID NO: 9641

SEQ ID NO: 14279 - protein, 162 aa, Escherichia coli E128010; identical to SEQ ID NO: 6365

SEQ ID NO: 14280 - protein, 367 aa, Escherichia coli E128010; identical to SEQ ID NO: 5784

SEQ ID NO: 14281 - protein, 192 aa, Escherichia coli E128010; identical to SEQ ID NO: 7894

SEQ ID NO: 14282 - protein, 65 aa, Escherichia coli E128010
DLMASGNTTVKATFGKDSSVVKWVVLAEVLVGAVMYMMTKNVKFLAGFAIISVFIAVGMAVVGLK

SEQ ID NO: 14283 - protein, 92 aa, Escherichia coli E128010
LRLARAVIPAAVLMMFFPQLAMAAQGQDLMASGNTTVKATFGKDSSVVKWVVLAEVLVGAVMYMMTKNVKFLAGFAIISVFIAVGMAVVGLK

SEQ ID NO: 14284 - protein, 446 aa, Escherichia coli E128010; identical to SEQ ID NO: 8470

SEQ ID NO: 14285 - protein, 614 aa, Escherichia coli E128010; identical to SEQ ID NO: 7971

SEQ ID NO: 14286 - protein, 208 aa, Escherichia coli E128010; identical to SEQ ID NO: 5717

SEQ ID NO: 14287 - protein, 50 aa, Escherichia coli E128010
FGPQMADLNLAFGVKNIFDQDYFIRSYDDNNKGIYAGQPRTLYMQGSLKF

SEQ ID NO: 14288 - protein, 230 aa, Escherichia coli E128010
MMTKIKLLMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLVILSRMKLFLRPIQLQELPAEAPDTLKFSRSGNYINVHNPSPFYVTLVNLQVGSQKLGNAMAAPRVSSQIPLPSGVQGKLKFQTVNDYGSVTPVREVNLN

SEQ ID NO: 14289 - protein, 820 aa, Escherichia coli E128010; identical to SEQ ID NO: 9222

SEQ ID NO: 14290 - protein, 365 aa, Escherichia coli E128010; identical to SEQ ID NO: 7931

SEQ ID NO: 14291 - protein, 351 aa, Escherichia coli E128010; identical to SEQ ID NO: 5767

SEQ ID NO: 14292 - protein, 161 aa, Escherichia coli E128010; identical to SEQ ID NO: 5769

SEQ ID NO: 14293 - protein, 266 aa, Escherichia coli E128010; identical to SEQ ID NO: 5772

SEQ ID NO: 14294 - protein, 747 aa, Escherichia coli E128010; identical to SEQ ID NO: 6343

SEQ ID NO: 14295 - protein, 230 aa, Escherichia coli E128010; identical to SEQ ID NO: 7855

SEQ ID NO: 14296 - protein, 765 aa, Escherichia coli E128010; identical to SEQ ID NO: 9418

SEQ ID NO: 14297 - protein, 170 aa, Escherichia coli E128010 [sequence omitted]

SEQ ID NO: 14298 - protein, 784 aa, Escherichia coli E128010
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTEPRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 14299 - protein, 432 aa, Escherichia coli E128010; identical to SEQ ID NO: 5727

SEQ ID NO: 14300 - protein, 331 aa, Escherichia coli E128010; identical to SEQ ID NO: 6456

SEQ ID NO: 14301 - protein, 760 aa, Escherichia coli E128010; identical to SEQ ID NO: 6455

SEQ ID NO: 14302 - protein, 203 aa, Escherichia coli E128010; identical to SEQ ID NO: 6414

SEQ ID NO: 14303 - protein, 237 aa, Escherichia coli E128010
MVYDALGYTDMLPEFGGDTAYSDDFFVGRVGGVATYRNSNFFGLVDGLNFAVQYLGKNERDTARRSNGDGVGGSISYEYEGFGIVGAYGAADRTNQQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 14304 - protein, 204 aa, Escherichia coli E128010; identical to SEQ ID NO: 9560

SEQ ID NO: 14305 - protein, 851 aa, Escherichia coli E128010; identical to SEQ ID NO: 9233

SEQ ID NO: 14306 - protein, 226 aa, Escherichia coli E128010
MIFAVLSLLVAGELRAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQLSVNGKALSNAGVVPPKSQRQTSWCQVIAPCHVAWRAINDYGGLSAKKEQNLP

SEQ ID NO: 14307 - protein, 518 aa, Escherichia coli E128010; identical to SEQ ID NO: 6358

SEQ ID NO: 14308 - protein, 119 aa, Escherichia coli E128010; identical to SEQ ID NO: 5986

SEQ ID NO: 14309 - protein, 469 aa, Escherichia coli E128010
REHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVCGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 14310 - protein, 193 aa, Escherichia coli E128010; identical to SEQ ID NO: 6300

SEQ ID NO: 14311 - protein, 746 aa, Escherichia coli E128010; identical to SEQ ID NO: 8482

SEQ ID NO: 14312 - protein, 243 aa, Escherichia coli E128010; identical to SEQ ID NO: 6463

SEQ ID NO: 14313 - protein, 659 aa, Escherichia coli E128010; identical to SEQ ID NO: 9226

SEQ ID NO: 14314 - protein, 430 aa, Escherichia coli E128010; identical to SEQ ID NO: 5758

SEQ ID NO: 14315 - protein, 118 aa, Escherichia coli E128010
MKKRGAFLGLLLVSASASVFAANNETSKSVTFPKCEGLDAAGIAASVKRDYQQNRVARWADDQKIVGQADPVAWVSLQDIQGKDDKWSVPLTVRGKSADIHYQVSVDCKAGMAEYQRR

SEQ ID NO: 14316 - protein, 351 aa, Escherichia coli E1520; identical to SEQ ID NO: 6367

SEQ ID NO: 14317 - protein, 372 aa, Escherichia coli E1520
MAKNKLGRLGNESDTYGELELGSEVYKKDDVSFYLDSMVSMVSDGSNDNETTLNDDAQFGLRQLNLQIKGLIPGDPNAVIWGGKRYYQRHDLHIIDTKYWNISGSGAGVENYTLGPGAVSLAWIRGDANDVDYRVDGDSNVNINYIDLRYAGWKPWAGSWTEFGIDYAMPNTTKKQDSYGGLYDADNGVMLTGEISQDMLGGYNKTVLQYANKGLAQNMVSQGGGWYDMWNYVNDATGYRVINTGLIPITEKFSINHVLTWGSADDITDYTDKTRMLSLVARGQYQFTDYVRLIGEVGGFYQKDSYNNGTSYKQAGEKYTIALGLADGPDFMSRPELRIFASYLNDSEDGKPFEDQTANNTWNFGVQVEAWW

SEQ ID NO: 14318 - protein, 385 aa, Escherichia coli E1520
MNIYRAVTSFFNNSSKKGLTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKALSVSTDDIVAVGLVYQF

SEQ ID NO: 14319 - protein, 230 aa, Escherichia coli E1520
MMTKIKLLMLIIFYLIISASDHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGNLKFQTVNDYGSVTPVREVNLN

SEQ ID NO: 14320 - protein, 530 aa, Escherichia coli E1520
MGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKILAALCRRKARWFVPILIPA

SEQ ID NO: 14321 - protein, 746 aa, Escherichia coli E1520
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWNVTKNVSLTGGVDNLFDKRLWRAGNAQTTGDLAGANYIAGAGAYTYNEPGRTWYMSVNTHF

SEQ ID NO: 14322 - protein, 193 aa, Escherichia coli E1520; identical to SEQ ID NO: 6300

SEQ ID NO: 14323 - protein, 242 aa, Escherichia coli E1520; identical to SEQ ID NO: 6420

SEQ ID NO: 14324 - protein, 815 aa, Escherichia coli E1520
MNIYRLSFVSCLVMAMPCALAVEFNLNVLDKSMRDRIDISLLKEKGVIAPGEYFVSVAVNNNQISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASNYRPQDGSSSTNLNAYGTTGINAGSWRLRSDYQLNNTDSEDSHEQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGMLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTRWNADASTTANITAGFNVDIGDWRDISISTSFNTTHYEDKDRDNQIYLSISLPFGNGGRVGYDMQNSSHSTIHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQYPPLGADIRQDDSGISVGMVGEEGHAWLSGVAENQLFTVVWGEQSCIIHLPERLEDTTKRLILPCH

SEQ ID NO: 14325 - protein, 431 aa, Escherichia coli E1520; identical to SEQ ID NO: 6791

SEQ ID NO: 14326 - protein, 331 aa, Escherichia coli E1520; identical to SEQ ID NO: 6551

SEQ ID NO: 14327 - protein, 760 aa, Escherichia coli E1520; identical to SEQ ID NO: 6415

SEQ ID NO: 14328 - protein, 203 aa, Escherichia coli E1520; identical to SEQ ID NO: 6414

SEQ ID NO: 14329 - protein, 362 aa, Escherichia coli E1520; identical to SEQ ID NO: 5809

SEQ ID NO: 14330 - protein, 224 aa, Escherichia coli E1520
MTVSLTTILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKRKEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 14331 - protein, 851 aa, Escherichia coli E1520
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGVQANSGIIDDDGSLYMAGLPAKGTISVRWGEAPDQICHINYELTEQQINSAITRMDAICR

SEQ ID NO: 14332 - protein, 161 aa, Escherichia coli E1520
MPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNVGVVPPKSQRQTSWCQAIAPCHVAWRAINDYGGLSAKKEQNLP

SEQ ID NO: 14333 - protein, 517 aa, Escherichia coli E1520; identical to SEQ ID NO: 6406

SEQ ID NO: 14334 - protein, 178 aa, Escherichia coli E1520; identical to SEQ ID NO: 8815

SEQ ID NO: 14335 - protein, 232 aa, Escherichia coli E1520; identical to SEQ ID NO: 5747

SEQ ID NO: 14336 - protein, 729 aa, Escherichia coli E1520
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQQFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDKIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 14337 - protein, 213 aa, Escherichia coli E1520; identical to SEQ ID NO: 5744

SEQ ID NO: 14338 - protein, 203 aa, Escherichia coli E1520; identical to SEQ ID NO: 6396

SEQ ID NO: 14339 - protein, 565 aa, Escherichia coli E1520; identical to SEQ ID NO: 6395

SEQ ID NO: 14340 - protein, 207 aa, Escherichia coli E1520; identical to SEQ ID NO: 5743

SEQ ID NO: 14341 - protein, 551 aa, Escherichia coli E1520; identical to SEQ ID NO: 5742

SEQ ID NO: 14342 - protein, 700 aa, Escherichia coli E1520; identical to SEQ ID NO: 6388

SEQ ID NO: 14343 - protein, 130 aa, Escherichia coli E1520; identical to SEQ ID NO: 7726

SEQ ID NO: 14344 - protein, 715 aa, Escherichia coli E1520
MLYNIPCRIYILSTLSLCISGIVSTATATSSETKISNEETLVVTTNRSASNLWESPATIQVIDQQTLHNSTNASIADNLQDIPGVEITDNSLAGRKQIRIRGEASSRVLILIDGQEVTYQRAGDNYGVGLLIDESALERVEIVKGPYSVLYGSQAIGGIVNFITKKGGNKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVNQRSGGMTSSKSLTGFINKETRTRSYYESEQSTVSLFTQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 14345 - protein, 826 aa, Escherichia coli E1520; identical to SEQ ID NO: 6373

SEQ ID NO: 14346 - protein, 239 aa, Escherichia coli E1520
MAAIPWRPFNLRGIKMKGLLSLLIFSMVLPAHAGIVIYGTRIIYPAENKEVMVQLMNQGNRSSLLQAWIDDGDTSLPPEKIQVPFMLTPPVAKIGENSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWHLTIIDDHGNYISDKI

SEQ ID NO: 14347 - protein, 663 aa, Escherichia coli E1520; identical to SEQ ID NO: 6307

SEQ ID NO: 14348 - protein, 828 aa, Escherichia coli E1520; identical to SEQ ID NO: 6366

SEQ ID NO: 14349 - protein, 162 aa, Escherichia coli E1520; identical to SEQ ID NO: 6365

SEQ ID NO: 14350 - protein, 367 aa, Escherichia coli E1520; identical to SEQ ID NO: 5789

SEQ ID NO: 14351 - protein, 200 aa, Escherichia coli E1520; identical to SEQ ID NO: 6363

SEQ ID NO: 14352 - protein, 274 aa, Escherichia coli E1520; identical to SEQ ID NO: 6362

SEQ ID NO: 14353 - protein, 250 aa, Escherichia coli E1520; identical to SEQ ID NO: 6361

SEQ ID NO: 14354 - protein, 881 aa, Escherichia coli E1520
MPDHSLFRLRILPWCIALAMSGSYSSVWAEDDIQFDSRFLELKGDTKIDLKRFSSQGYVEPGKYNLQVQLNKQPLAEEYDIYWYAGEDDVSKSYACLTPELVAQFGLKEDVAKNLQWSHDGKCLKPGQLEGMEIKADLSQSALVISLPQAYLEYTWPDWDPPSRWDDGISGIIADYSITAQTRHEENGGDDSNEISGNGTVGVNLGPWRMRADWQTNYQHTRSNDDDDEFGGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGGFFSGAKASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNIGTSDKHTSVDGYYSHDGSLAQVDLSANYHEGQYTSAGLSLQGGATLTTHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGSVYLAGVKPGEYMSVFWSGVAHCDINLPDPLPADLFNGLLLPCQHKGNVAPVVPDDIKPVIQEQTQQVTPTDPPVSVSANQ

SEQ ID NO: 14355 - protein, 518 aa, Escherichia coli E1520; identical to SEQ ID NO: 6358

SEQ ID NO: 14356 - protein, 678 aa, Escherichia coli E1520
MVPSTFSRLKAARCLPVVLAALIFAGCGTHTPDQSTAYMQGTAQADSAFYLQQMQQSSDDTRINWQLLAIRALVKEGKTGQAVELFNQLPQELNDAQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVIGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRNLSWLQYQQGQVVPVS

SEQ ID NO: 14357 - protein, 806 aa, Escherichia coli E1520
MLCTTANAEEYYFDPIMLETTKSGMQTTDLSRFSKKYAQLSGTYQVDIWLNKKKVSQKKITFTANAEQLLQPQFTVEQLRELGIKVDEIPALAEKDDDSVINSLEQIIPGTAAEFDFNHQQLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVSAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDNDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 14358 - protein, 231 aa, Escherichia coli E1520; identical to SEQ ID NO: 6400

SEQ ID NO: 14359 - protein, 125 aa, Escherichia coli E1520; identical to SEQ ID NO: 12830

SEQ ID NO: 14360 - protein, 837 aa, Escherichia coli E1520
MDQMYKKLKLTTISELIKNIYCSLSVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 14361 - protein, 360 aa, Escherichia coli E1520; identical to SEQ ID NO: 6702

SEQ ID NO: 14362 - protein, 432 aa, Escherichia coli E1520; identical to SEQ ID NO: 5727

SEQ ID NO: 14363 - protein, 446 aa, Escherichia coli E1520; identical to SEQ ID NO: 6459

SEQ ID NO: 14364 - protein, 237 aa, Escherichia coli E1520; identical to SEQ ID NO: 6384

SEQ ID NO: 14365 - protein, 478 aa, Escherichia coli E1520; identical to SEQ ID NO: 5711

SEQ ID NO: 14366 - protein, 241 aa, Escherichia coli E1520
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENALRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGIME

SEQ ID NO: 14367 - protein, 440 aa, Escherichia coli E1520
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTTMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINSWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKTRFFQSTLLHGLPAGWTIYGGTQLVDRYRAFNFGIGKNMGHWALCLWI

SEQ ID NO: 14368 - protein, 784 aa, Escherichia coli E1520; identical to SEQ ID NO: 6283

SEQ ID NO: 14369 - protein, 266 aa, Escherichia coli E1520; identical to SEQ ID NO: 8295

SEQ ID NO: 14370 - protein, 161 aa, Escherichia coli E1520; identical to SEQ ID NO: 5769

SEQ ID NO: 14371 - protein, 866 aa, Escherichia coli E1520
MSRKIIKTHNNKLTYIASFCALLLSPCAISAEHVEYDNTFLMGQDASNIDLSRYTEGNPTLPGVYDVSVYVNDQPVISQNISFITLEGKKNAQACITLKNLLQFHINQPDIKDENAILLQREEELGDCLDLGNVIPQASVHYDVNDQRLDINVPQAWVMKNYQNYVDPSLWENGINAAMLSYNVNAYHSEIPDRKNDSVYAAFNGGINLGAWRLRATGNYNWMTDAGTNYDFQNRYLQRDLASLRSQLVVGESYTTGETFDSVSIRGVRLYSDSRMLPPTLASFAPIIHGVANTNAKVTITQGGYKIYETTVPPGAFVIDDVSPSGYGSDLIVTIEESDGTKRTFSQPFSSVVQMLRPGVGRWDISAGKILKDDIQNEPNLFQASYYYGLNNLLTGYTGIQITDNNYTAGLLGLGLNTTYGAFSVDVTHSDVQIPDDKTYRGQSYRLSWNKLFEDTRTSLNIAAYRYSTQNYLGLNDALTLIDEVKHPEQDLEPKNMRNYSRMKNQVTVSINQPLKYGKEDYGSFYLSGSWSDYWASGQNNTNYSLGYSNSASWGSYSISAQRSRDQDGDNEDSIYLSFSIPIEKLLGTEHRNSGFQTIDTQLSSDFDGSNQLSISSSGFSDDNRISYSVNTGYSMMKSSDDLSYIGGYASYESPWGTLASSVSASSDNSRQISFNTDGGFVLHSGGLTFSNDSFSDSDTLAVIQAPGAKGARINYGNSTVDRWGYGVTNALSPYHENRIALDINGLENDVELKSTSAVAVPRQGSVVFAGFETVQGQSAIMNIKRTDGKNIPFAADIYDENGNIIGNVGQGGQAFVRGIEQQGNIRINWLDEGKPVTCLAHYQQSAAPEKIAQSIILNGISCQIK

SEQ ID NO: 14372 - protein, 246 aa, Escherichia coli E1520
MFLNAKHTAALCFAACMSLSTSAIADIVISGTRVIYKSDQKSVNVRLENKGNNPLLVQSWLDTGDDSAEPGSIKVPFTATPPVSRIDAKRSQTIKLMYTASSPLPKDRESVFWFNVLEVPPQPDADKVANQSLLQLAFRTRIKLFYRPEGLNGLPTDAPAALKWSWTTSAGKTALRVANPTPYHVSFSSGDLVANGKTYPLDVKMVAPLSEETFYIKGMSGKASSAKVHFFAINDFGGAIEGNASL

SEQ ID NO: 14373 - protein, 731 aa, Escherichia coli E1520
MARSKTAQPKHSLRKIAVVVATAVSGMSVYAQAAVEPKEDTITVTAAPAPQESAWGPAATIAAKHSATATKTDTPIEKTPQSISVVTREEMDIKQPATVKEALDYTPSVFSTRGSSTTYDVVSIRGFTTPSTVNTNQYLDGLKLQGDNYSEASIDPYFLERVELLRGPVSVLYGKSHPGGVVSMVSKRPSTDPIKEIQFKMGTDNLWQTGFDFSDAIDDDGVWSYRLTGLGRSQDAQQKYAKTTRYAVAPSFSWRPDDKTDLTFLSNFQSDPDAGYYGWLPRQGTVVPYQDANGSWHKLPTDFNEGEKDNKMSRRQQLIGYSFAHEFNDTFTVRQNLRYTRIHTLYDAVYGNSYIAPAQISRAYVRSDEDLNSFTVDTQLQSNFATGAVAHTLLTGVDYLRMRNDIDANYGTADPISMQDPQYGNANININFPYAVINRQEQTGLYIQDQSEWNKWVLTLGGRYDFAKTSTYTRSTSSLDEINDQQFTWRGGINYLFDNGISPYFSYSESFEPVSGATKEGKPFDPSRGKQYEAGVKYVPKDTPVTVTASVFQLTKDKNLTADPSNILFSVQGGEIRSRGFEIEAKAALNANINVTAAYNYTDAEYTKDTLYKGKRPAEVPRNMASLWADYTFRETALSGLSFGAGARYFGDTSSFYTTGEKANQTFNVGGYTLVDAMIKYDLARFGMPGSSVGVNVNNLFDREYVSSCYRDYACYWGAERQVVATATFRF

SEQ ID NO: 14374 - protein, 412 aa, Escherichia coli E1520
MKQWIAALLLMLIPGVQAAKPQKVTLMVDDVPVAQVLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPLFGQLFRHDGKEDERRELVVFITPRLVSSE

SEQ ID NO: 14375 - protein, 897 aa, Escherichia coli E1520
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKSNDASNPWRYVRAATATEISETSNPQSCTSAPQPSPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGGAVTPVDPTPETPVTPTPDNSEPSTPADSVNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLKVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMIGVNDVQGEVFYLSDARLVMQDAQKRNLGMVGIWSIARDLPGGTNLSPEFHGLTKEQAPKYAFSEIFAPFTKQ

SEQ ID NO: 14376 - protein, 654 aa, Escherichia coli E1520
MDCVMKGLNKITCCLLAALLMPCAGHAENEQYGANFNNADIRQFVEIVGQQLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 14377 - protein, 208 aa, Escherichia coli E1520
MKKIWLALAGLVLAFSASAAQYEDGKQYTTLEKPVAGAPQVLEFFSFFCPHCYQFEEVLHISDNVKKKLPEGVKMTKYHVNFMGGDVGKDLTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSNMDVFVQQYANTVKYLSEKK

SEQ ID NO: 14378 - protein, 614 aa, Escherichia coli E1520; identical to SEQ ID NO: 6387

SEQ ID NO: 14379 - protein, 228 aa, Escherichia coli E22; identical to SEQ ID NO: 9270

SEQ ID NO: 14380 - protein, 843 aa, Escherichia coli E22
MHWMHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYNALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVHAVCEK

SEQ ID NO: 14381 - protein, 412 aa, Escherichia coli E22; identical to SEQ ID NO: 6495

SEQ ID NO: 14382 - protein, 512 aa, Escherichia coli E22; identical to SEQ ID NO: 6251

SEQ ID NO: 14383 - protein, 686 aa, Escherichia coli E22; identical to SEQ ID NO: 6453

SEQ ID NO: 14384 - protein, 834 aa, Escherichia coli E22
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQTGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 14385 - protein, 249 aa, Escherichia coli E22; identical to SEQ ID NO: 6450

SEQ ID NO: 14386 - protein, 231 aa, Escherichia coli E22; identical to SEQ ID NO: 6351

SEQ ID NO: 14387 - protein, 662 aa, Escherichia coli E22; identical to SEQ ID NO: 8481

SEQ ID NO: 14388 - protein, 663 aa, Escherichia coli E22
MFRLNPFVRVGLCLSAISCAWHVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 14389 - protein, 828 aa, Escherichia coli E22; identical to SEQ ID NO: 6558

SEQ ID NO: 14390 - protein, 162 aa, Escherichia coli E22; identical to SEQ ID NO: 6365

SEQ ID NO: 14391 - protein, 367 aa, Escherichia coli E22; identical to SEQ ID NO: 5784

SEQ ID NO: 14392 - protein, 200 aa, Escherichia coli E22; identical to SEQ ID NO: 6311

SEQ ID NO: 14393 - protein, 274 aa, Escherichia coli E22; identical to SEQ ID NO: 8357

SEQ ID NO: 14394 - protein, 250 aa, Escherichia coli E22; identical to SEQ ID NO: 6317

SEQ ID NO: 14395 - protein, 880 aa, Escherichia coli E22; identical to SEQ ID NO: 6482

SEQ ID NO: 14396 - protein, 551 aa, Escherichia coli E22; identical to SEQ ID NO: 5742

SEQ ID NO: 14397 - protein, 700 aa, Escherichia coli E22; identical to SEQ ID NO: 9243

SEQ ID NO: 14398 - protein, 826 aa, Escherichia coli E22; identical to SEQ ID NO: 8499

SEQ ID NO: 14399 - protein, 224 aa, Escherichia coli E22; identical to SEQ ID NO: 6435

SEQ ID NO: 14400 - protein, 446 aa, Escherichia coli E22; identical to SEQ ID NO: 8470

SEQ ID NO: 14401 - protein, 478 aa, Escherichia coli E22; identical to SEQ ID NO: 8471

SEQ ID NO: 14402 - protein, 351 aa, Escherichia coli E22; identical to SEQ ID NO: 5767

SEQ ID NO: 14403 - protein, 161 aa, Escherichia coli E22; identical to SEQ ID NO: 5769

SEQ ID NO: 14404 - protein, 266 aa, Escherichia coli E22; identical to SEQ ID NO: 5772

SEQ ID NO: 14405 - protein, 747 aa, Escherichia coli E22; identical to SEQ ID NO: 6343

SEQ ID NO: 14406 - protein, 246 aa, Escherichia coli E22
MFFNTKHTTALCFVTCMAFSSSSIADIVISGTHVIYKSDQKSVNVRLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVTGLNGKASSAKVHFYAINDFGGAIEGNASL

SEQ ID NO: 14407 - protein, 866 aa, Escherichia coli E22; identical to SEQ ID NO: 8486

SEQ ID NO: 14408 - protein, 193 aa, Escherichia coli E22
MRYLATLLLSLAVLITAGCGWHLRDTTQVPSTMKVMILDSGDPNGPLSCAVRNQLRLNGVELLDKETTRKDVPSLRLGKVSIAKDTASVFRNGQTAEYQMIMTVNATVLIPGRDIYPISAKVFRSFFDNPQMALAKDNEQDMIVKEMYDRAAEQLIRKLPSIRAADIRSDEEQTSTTTDTPATPARVSTTLGN

SEQ ID NO: 14409 - protein, 746 aa, Escherichia coli E22; identical to SEQ ID NO: 9358

SEQ ID NO: 14410 - protein, 365 aa, Escherichia coli E22; identical to SEQ ID NO: 7931

SEQ ID NO: 14411 - protein, 359 aa, Escherichia coli E22; identical to SEQ ID NO: 6332

SEQ ID NO: 14412 - protein, 368 aa, Escherichia coli E22; identical to SEQ ID NO: 7974

SEQ ID NO: 14413 - protein, 241 aa, Escherichia coli E22; identical to SEQ ID NO: 6143

SEQ ID NO: 14414 - protein, 863 aa, Escherichia coli E22; identical to SEQ ID NO: 9275

SEQ ID NO: 14415 - protein, 507 aa, Escherichia coli E22
MFAPSLEKALRETQSELKKYKDEEKKKYTPATVNRSVSTNDQGYAANPFPTSSAAKPDAVLVKNEEKNASETGSIYSSMTLKDFSKFVKDEIGFSYNGYYRSGWGTASHGSPKSWAIGSLGRFGNEYSGWFDLQLKQRVYNENGKRVDAVVMMDGNVGQQYSTGWFGDNAGGENFMQFSDMYVTTKGFLPFAPEADFWVGKHGAPKIEIQMLDWKTQRTDAAAGVGLENWKVGPGKIDIALVREDVDDYDRSLQNKQQINTNAIDLRYKDIPLWDKATLMVSGRYVTANESASEKDNQDNNGYYDWKDTWMFGTSLTQKFDKGGFNEFSFLVANNSIASNFGRYAGASPFTTFNGRYYGDHTGGTAVRLTSQGEAYIGDHFIVANAIVYSFGNDIYSYETGAHSDFESIRAVVRPAYIWDQYNQTGVELGYFTQQNKDANSNKFNESGYKTTLFHTFKVNTSMLTSRPEIRFYATYIKALENELDGFTFEDNKDDQFAVGAQAEIWW

SEQ ID NO: 14416 - protein, 614 aa, Escherichia coli E22; identical to SEQ ID NO: 7971

SEQ ID NO: 14417 - protein, 518 aa, Escherichia coli E22; identical to SEQ ID NO: 6358

SEQ ID NO: 14418 - protein, 230 aa, Escherichia coli E22; identical to SEQ ID NO: 6294

SEQ ID NO: 14419 - protein, 871 aa, Escherichia coli E22; identical to SEQ ID NO: 9244

SEQ ID NO: 14420 - protein, 236 aa, Escherichia coli E22; identical to SEQ ID NO: 7814

SEQ ID NO: 14421 - protein, 760 aa, Escherichia coli E22
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPMTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 14422 - protein, 331 aa, Escherichia coli E22; identical to SEQ ID NO: 6456

SEQ ID NO: 14423 - protein, 517 aa, Escherichia coli E22; identical to SEQ ID NO: 6817

SEQ ID NO: 14424 - protein, 191 aa, Escherichia coli E22; identical to SEQ ID NO: 5748

SEQ ID NO: 14425 - protein, 232 aa, Escherichia coli E22; identical to SEQ ID NO: 5747

SEQ ID NO: 14426 - protein, 226 aa, Escherichia coli E22; identical to SEQ ID NO: 7934

SEQ ID NO: 14427 - protein, 851 aa, Escherichia coli E22; identical to SEQ ID NO: 9233

SEQ ID NO: 14428 - protein, 224 aa, Escherichia coli E22; identical to SEQ ID NO: 7869

SEQ ID NO: 14429 - protein, 362 aa, Escherichia coli E22; identical to SEQ ID NO: 5809

SEQ ID NO: 14430 - protein, 203 aa, Escherichia coli E22; identical to SEQ ID NO: 6414

SEQ ID NO: 14431 - protein, 111 aa, Escherichia coli E22; identical to SEQ ID NO: 8460

SEQ ID NO: 14432 - protein, 432 aa, Escherichia coli E22; identical to SEQ ID NO: 5727

SEQ ID NO: 14433 - protein, 240 aa, Escherichia coli E22
MINFSRMKHFSINRLATTFGLTLAVLMSSQSALASLSADQTRYVFKGNKGSLTITVTNNDKEKTFGGQAWVDNIVEKDTRPTFVVTPSFFKVKPNGQQTLRVIKASDHVPQDKESVYWLNLQDIPPAMDGNGIAVALRTKLKVFYRPTALLEGRKGAEEGITFKVRPDGRNVLVNTTPYIYAIGNLLDANGKKISVDSDAAKNLLMFMPGDEVPVNGKVVKVESLNDYGEIETWEVNKKR

SEQ ID NO: 14434 - protein, 253 aa, Escherichia coli E22
MYKYIKIFIPALFLTSFLSHAQTANTSVAKSNAIIKTEDKIYGLRLGSTRVIYNEGMLASSFWIKNEKKYPIIVQSQVFSDDKKTKAPFIITPPVLRLESEIQTRLRIVPVSNVLKKDRESLFWICVKGIPPENISSYDTEDNNKSAYVNINVITNSCIKLLARPKSVDISVEEANKKLRWGIKEGELLVENPSPLYINIARITVNGKEVAIPDGYIEPYKSVSNIAKASKGDKVNSVVLDDIGAEINNEVTL

SEQ ID NO: 14435 - protein, 243 aa, Escherichia coli E22; identical to SEQ ID NO: 6463

SEQ ID NO: 14436 - protein, 119 aa, Escherichia coli E22; identical to SEQ ID NO: 6116

SEQ ID NO: 14437 - protein, 122 aa, Escherichia coli E22; identical to SEQ ID NO: 5737

SEQ ID NO: 14438 - protein, 729 aa, Escherichia coli E22; identical to SEQ ID NO: 5745

SEQ ID NO: 14439 - protein, 213 aa, Escherichia coli E22; identical to SEQ ID NO: 5744

SEQ ID NO: 14440 - protein, 565 aa, Escherichia coli E22; identical to SEQ ID NO: 6492

SEQ ID NO: 14441 - protein, 203 aa, Escherichia coli E22; identical to SEQ ID NO: 6347

SEQ ID NO: 14442 - protein, 208 aa, Escherichia coli E22; identical to SEQ ID NO: 5717

SEQ ID NO: 14443 - protein, 351 aa, Escherichia coli E482
MKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFSISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 14444 - protein, 230 aa, Escherichia coli E482; identical to SEQ ID NO: 6360

SEQ ID NO: 14445 - protein, 867 aa, Escherichia coli E482; identical to SEQ ID NO: 6359

SEQ ID NO: 14446 - protein, 746 aa, Escherichia coli E482; identical to SEQ ID NO: 6710

SEQ ID NO: 14447 - protein, 193 aa, Escherichia coli E482; identical to SEQ ID NO: 6300

SEQ ID NO: 14448 - protein, 242 aa, Escherichia coli E482; identical to SEQ ID NO: 6420

SEQ ID NO: 14449 - protein, 815 aa, Escherichia coli E482; identical to SEQ ID NO: 6927

SEQ ID NO: 14450 - protein, 430 aa, Escherichia coli E482; identical to SEQ ID NO: 5758

SEQ ID NO: 14451 - protein, 331 aa, Escherichia coli E482; identical to SEQ ID NO: 6551

SEQ ID NO: 14452 - protein, 760 aa, Escherichia coli E482; identical to SEQ ID NO: 6415

SEQ ID NO: 14453 - protein, 203 aa, Escherichia coli E482; identical to SEQ ID NO: 6414

SEQ ID NO: 14454 - protein, 362 aa, Escherichia coli E482; identical to SEQ ID NO: 5809

SEQ ID NO: 14455 - protein, 224 aa, Escherichia coli E482; identical to SEQ ID NO: 7705

SEQ ID NO: 14456 - protein, 851 aa, Escherichia coli E482; identical to SEQ ID NO: 14331

SEQ ID NO: 14457 - protein, 226 aa, Escherichia coli E482; identical to SEQ ID NO: 6432

SEQ ID NO: 14458 - protein, 517 aa, Escherichia coli E482; identical to SEQ ID NO: 6406

SEQ ID NO: 14459 - protein, 191 aa, Escherichia coli E482; identical to SEQ ID NO: 5748

SEQ ID NO: 14460 - protein, 232 aa, Escherichia coli E482; identical to SEQ ID NO: 5747

SEQ ID NO: 14461 - protein, 729 aa, Escherichia coli E482; identical to SEQ ID NO: 6402

SEQ ID NO: 14462 - protein, 213 aa, Escherichia coli E482; identical to SEQ ID NO: 5744

SEQ ID NO: 14463 - protein, 203 aa, Escherichia coli E482; identical to SEQ ID NO: 6396

SEQ ID NO: 14464 - protein, 565 aa, Escherichia coli E482; identical to SEQ ID NO: 6395

SEQ ID NO: 14465 - protein, 207 aa, Escherichia coli E482; identical to SEQ ID NO: 5743

SEQ ID NO: 14466 - protein, 551 aa, Escherichia coli E482; identical to SEQ ID NO: 6971

SEQ ID NO: 14467 - protein, 700 aa, Escherichia coli E482; identical to SEQ ID NO: 6388

SEQ ID NO: 14468 - protein, 678 aa, Escherichia coli E482
MVPSTFSRLKAARCLPVVLAALIFAGCGTHTPDQSTAYMQGTAQADSAFYLQQMQQSSDDTRINWQLLAIRALVKEGKTGQAVELFNQLPQELNDAQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPVS

SEQ ID NO: 14469 - protein, 806 aa, Escherichia coli E482
MLCTTANAEEYYFDPIMLETTKSGIQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWNYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 14470 - protein, 199 aa, Escherichia coli E482
MIYDASRKEAALPVANKGAETPYLLQSWVDNIDGKSRAPFIITPPLFRLEAGDDSSLRIIKTADNLPENKESLFYINVRAIPAKKKSDDVNANELTLVFKTRIKMFYRPAHLKGRVNDAWKSLEFKRSDHSLNIYNPTEYYVVFAGLAVDKIDLTSKIEYIAPGEHKQLPLPASGGKNVKWAAINDYGGSSGTETRPLQ

SEQ ID NO: 14471 - protein, 249 aa, Escherichia coli E482; identical to SEQ ID NO: 6519

SEQ ID NO: 14472 - protein, 835 aa, Escherichia coli E482
MDQMYKKLKLTTISELIKNIYCSLSVIIIGCASAYAVEFNKDLIEAEDRENVNLSQFETDGQLPVGKYSLSTLINNKRTPIHLDLQWVLIDNLTAVCVTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFSITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLATGVGFNLNSLGSLSFDVTRSDAQLHNQNKETGYSYRANYSKRFESTGSQLTFAGYRFSDKNFVSMNEYINDTNHYTNYQNEKESYIVTFNQYLESLRLNTYVSLARNTYWDASSNVNYSLSLSRDFDIGPLKNVSTSLTFSRINWEDDNQDQLYLNISIPWGTSRTLSYGMQRNQDNNISHTASWYDSSDRNNSWSVSASGDNDEFKDMEASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDETSHKELGLVADGGFVYLNGIQDDSKLTLRWGDKSCFIQPPKSSNLTTGTVILPCIS

SEQ ID NO: 14473 - protein, 615 aa, Escherichia coli E482
MFWRDITLSVWRKKTTCLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSSNVVNYDPSNVIMLTGRASVVERLTEVIQRVDHAGNRTEEVIPLDNASASEIARVLESLTKNSGENQPAPLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKENVT

SEQ ID NO: 14474 - protein, 359 aa, Escherichia coli E482; identical to SEQ ID NO: 6332

SEQ ID NO: 14475 - protein, 432 aa, Escherichia coli E482; identical to SEQ ID NO: 5727

SEQ ID NO: 14476 - protein, 330 aa, Escherichia coli E482
MEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 14477 - protein, 881 aa, Escherichia coli E482; identical to SEQ ID NO: 7317

SEQ ID NO: 14478 - protein, 250 aa, Escherichia coli E482; identical to SEQ ID NO: 6361

SEQ ID NO: 14479 - protein, 274 aa, Escherichia coli E482; identical to SEQ ID NO: 6362

SEQ ID NO: 14480 - protein, 200 aa, Escherichia coli E482; identical to SEQ ID NO: 6363

SEQ ID NO: 14481 - protein, 367 aa, Escherichia coli E482; identical to SEQ ID NO: 5789

SEQ ID NO: 14482 - protein, 162 aa, Escherichia coli E482; identical to SEQ ID NO: 6365

SEQ ID NO: 14483 - protein, 828 aa, Escherichia coli E482; identical to SEQ ID NO: 6366

SEQ ID NO: 14484 - protein, 663 aa, Escherichia coli E482; identical to SEQ ID NO: 6307

SEQ ID NO: 14485 - protein, 239 aa, Escherichia coli E482; identical to SEQ ID NO: 6428

SEQ ID NO: 14486 - protein, 826 aa, Escherichia coli E482
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSEFVQVGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYTLAASQAYDENHHEEKRFNIFISIPFDWGDDVTTPRRQIYMSNSTTFDDQGFASNNTGLSGTVGSRDQFNYGVNLSYQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 14487 - protein, 122 aa, Escherichia coli E482; identical to SEQ ID NO: 5737

SEQ ID NO: 14488 - protein, 111 aa, Escherichia coli E482; identical to SEQ ID NO: 8122

SEQ ID NO: 14489 - protein, 446 aa, Escherichia coli E482 [sequence omitted]

SEQ ID NO: 14490 - protein, 237 aa, Escherichia coli E482; identical to SEQ ID NO: 6384

SEQ ID NO: 14491 - protein, 774 aa, Escherichia coli E482
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTITPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 14492 - protein, 161 aa, Escherichia coli E482; identical to SEQ ID NO: 5769

SEQ ID NO: 14493 - protein, 266 aa, Escherichia coli E482; identical to SEQ ID NO: 5772

SEQ ID NO: 14494 - protein, 747 aa, Escherichia coli E482; identical to SEQ ID NO: 6343

SEQ ID NO: 14495 - protein, 246 aa, Escherichia coli E482; identical to SEQ ID NO: 6964

SEQ ID NO: 14496 - protein, 865 aa, Escherichia coli E482; identical to SEQ ID NO: 6375

SEQ ID NO: 14497 - protein, 784 aa, Escherichia coli E482
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQIGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 14498 - protein, 227 aa, Escherichia coli E482
MRIIIALLMSFFILPVHAGMVIYGTRIIYPKKNREVLVQLMNQSKNASLIQAWIDDGNTTIAPEKIQVLFILTPPVSRVAGGSGQQLKIRKMPNNLPHNKESLFYLNVLDIPPNNPQNAGKNKIKLAFQNRIKLLWRPSGIAPVDKKSLSQLNIKKKNNAISINNETANWITVTTIKAQNVKVNNESILLPPFSNNDITLKNNHASEYELTVVDDYGNNIHSKIAAR

SEQ ID NO: 14499 - protein, 816 aa, Escherichia coli E482
MLRTTRWVAAIIFLYSFPGYAEETFDTHFMIGGMRGEKVSEYRFDNKQPLPGNYELDFYVNHQWRGKKDITIPESPAKPCLPKVLLTTLGVKTDNLNTEDNCILLDEAVHGGQYQWDISEHRLNLTIPQAYINELERGYVPPESWDRGIDAFYTSYNLSQYRSYDSNNNSNTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYIIYQKEVPPGPFTIADLQLSGSGADLDVSIKEADGSVRSFLVPYSSVPNMLQPGVSNFDFIAGRSKIYGVKNQEDFLEANYIYGLNNLLTLYGGTILSDNYNAITLGNGWNTPLGAISFDATRSSSKLNNDITHEGTSYQVAYNKYLVQTATRFSVAAWRYASQDYRTFSDHLYENDKHNHQSEYDDFYDIGRKNSLSANIMQPLSNNLGNVSLSALWRNYWGRSGNAKDYQFSYSNSWQRISYTFSASQSYDENDKEEERFNLFISIPFYWGDDITKTRHQINLSNSTSFSKDGYSSNNTGVTGIAGEHDQLNYGIYVNQQQQNNDTSLGTNLSWRTPIAIIDGSYSHSKNTWQSGGSISSGLVVWPGGINITNQLSDTFAILDAPGLEGAHINGQKYNRTNSKGQVVYDLMIPHRENHLVLDIANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 14500 - protein, 878 aa, Escherichia coli E482
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTLTLYLSGSHQTYWGTSNVDEQFQAGLNTAFEDINWTLSYSLTKNAWQKGRDQMLALNVNIPFSHWLRSDSKSQWRHASASYSMSHDLNGRMTNLVGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 14501 - protein, 241 aa, Escherichia coli E482; identical to SEQ ID NO: 6143

SEQ ID NO: 14502 - protein, 368 aa, Escherichia coli E482; identical to SEQ ID NO: 8468

SEQ ID NO: 14503 - protein, 412 aa, Escherichia coli E482; identical to SEQ ID NO: 6390

SEQ ID NO: 14504 - protein, 897 aa, Escherichia coli E482
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGGAVTPVDPTPETPVTPTPDNSEPSTPADSGNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 14505 - protein, 504 aa, Escherichia coli E482
MMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 14506 - protein, 852 aa, Escherichia coli E482
MRYPVIYLFVNLVMRGMKDRIPFAVNNITCVILLSLFCNAASAVEFNTDVLDAADKKNIDFTRFSEAAYVLPGQYLLDVIVNGQSISPASLQISFVEPALSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNITSVDLKRLPDDVEATRSVVESALTEGAIGYRKFSVLKGKRLFAILRLADGSQPPFGASVTSEKGRELGMVADEGLAWLSGVTPGETLSVNWDEKIQCQVNVPETAISDQQLLLPCTPQK

SEQ ID NO: 14507 - protein, 239 aa, Escherichia coli E482
MIRKKILMAAIPLFVISGADAAVSLDRTRAVFDGSEKSMTLDISNDNKQLPYLAQAWIENENQEKIITGPVIATPPVQRLEPGARSMVRLSTTPDISKLPQDRESLFYFNLREIPPRSEKANVLQIALQTKIKLFYRPAAIKTRPNEVWQDQLILNKVSGGYRIENPTPYYVTVIGLGGSEKQAEEGEFETVMLSPRSEQTVKSANYNTPYLSYINDYGGRPVLSFICNGSRCSVKKEK

SEQ ID NO: 14508 - protein, 208 aa, Escherichia coli E482; identical to SEQ ID NO: 5717

SEQ ID NO: 14509 - protein, 614 aa, Escherichia coli E482; identical to SEQ ID NO: 6387

SEQ ID NO: 14510 - protein, 432 aa, Escherichia coli EC4100B; identical to SEQ ID NO: 5727

SEQ ID NO: 14511 - protein, 359 aa, Escherichia coli EC4100B; identical to SEQ ID NO: 6332

SEQ ID NO: 14512 - protein, 203 aa, Escherichia coli EC4100B; identical to SEQ ID NO: 6414

SEQ ID NO: 14513 - protein, 362 aa, Escherichia coli EC4100B; identical to SEQ ID NO: 5809

SEQ ID NO: 14514 - protein, 224 aa, Escherichia coli EC4100B; identical to SEQ ID NO: 7869

SEQ ID NO: 14515 - protein, 851 aa, Escherichia coli EC4100B; identical to SEQ ID NO: 8686

SEQ ID NO: 14516 - protein, 120 aa, Escherichia coli EC4100B; identical to SEQ ID NO: 14165

SEQ ID NO: 14517 - protein, 686 aa, Escherichia coli EC4100B; identical to SEQ ID NO: 7383

SEQ ID NO: 14518 - protein, 834 aa, Escherichia coli EC4100B; identical to SEQ ID NO: 8715

SEQ ID NO: 14519 - protein, 249 aa, Escherichia coli EC4100B; identical to SEQ ID NO: 6450

SEQ ID NO: 14520 - protein, 231 aa, Escherichia coli EC4100B; identical to SEQ ID NO: 6351

SEQ ID NO: 14521 - protein, 823 aa, Escherichia coli EC4100B
MALIIKRCLPMVLTGSGMLCTTANAEEYYFAPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 14522 - protein, 678 aa, Escherichia coli EC4100B; identical to SEQ ID NO: 9900

SEQ ID NO: 14523 - protein, 740 aa, Escherichia coli EC4100B
MADASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 14524 - protein, 236 aa, Escherichia coli EC4100B; identical to SEQ ID NO: 7814

SEQ ID NO: 14525 - protein, 614 aa, Escherichia coli EC4100B
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHFGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMDGVSLWDLAVAYPVTSHLTVRGKIANLFDKDYETVYGYQTAGREYTLSGSYTF

SEQ ID NO: 14526 - protein, 512 aa, Escherichia coli EC4100B; identical to SEQ ID NO: 6120

SEQ ID NO: 14527 - protein, 365 aa, Escherichia coli EC4100B; identical to SEQ ID NO: 7931

SEQ ID NO: 14528 - protein, 230 aa, Escherichia coli EC4100B
MMTKIKLLMLIIFYLIISASSHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVSSQIPLPSGVQGKLKFQTVNDYGSVTPVREVNLN

SEQ ID NO: 14529 - protein, 228 aa, Escherichia coli EC4100B; identical to SEQ ID NO: 9903

SEQ ID NO: 14530 - protein, 843 aa, Escherichia coli EC4100B
MHWMHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYLNLRSGLNVGPWRLLNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYNALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 14531 - protein, 243 aa, Escherichia coli EC4100B; identical to SEQ ID NO: 6145

SEQ ID NO: 14532 - protein, 351 aa, Escherichia coli EC4100B; identical to SEQ ID NO: 7351

SEQ ID NO: 14533 - protein, 191 aa, Escherichia coli EC4100B; identical to SEQ ID NO: 6437

SEQ ID NO: 14534 - protein, 232 aa, Escherichia coli EC4100B; identical to SEQ ID NO: 5747

SEQ ID NO: 14535 - protein, 729 aa, Escherichia coli EC4100B; identical to SEQ ID NO: 9878

SEQ ID NO: 14536 - protein, 213 aa, Escherichia coli EC4100B; identical to SEQ ID NO: 9865

SEQ ID NO: 14537 - protein, 407 aa, Escherichia coli EC4100B
MTERELSIIRALGEEFSTVLADLQRTFEGKMAAQAQAFEEKLASLSAVLQKHVTVDEVHPVLQAMVDDAVGAIPVPRDGRDYDPDVLQQAVNDAVANIPVPADGKSITPDDVRPMLEQMVKEAVSHIPVPRDGRDYDPDVLQQAVNDAVANIPVPADGKSITPDDVRPMLEQMVKEAVSHIPAPRDGRDYDPEVLKQAVNDAVANIPVPADGKSITPDDVRPMLEQMVKEAVSHIPVPRDGRDYDPDVLQKAVLDAVRALPAPQDGRDATALEIIPAIDDQKSFPRGTYATHQGGLWRAYEKTHGMRGWECLVDGVADIDVSMTGERLFSVVIRHSSGQRTEKTFSLPVMLYRGVFRAGETYHPGDTVTWGGSLWHCNSMTGDKPGEAHSSGWTLAAKRGRDAGGGK

SEQ ID NO: 14538 - protein, 161 aa, Escherichia coli EC4100B; identical to SEQ ID NO: 5769

SEQ ID NO: 14539 - protein, 478 aa, Escherichia coli EC4100B; identical to SEQ ID NO: 8712

SEQ ID NO: 14540 - protein, 237 aa, Escherichia coli EC4100B; identical to SEQ ID NO: 6313

SEQ ID NO: 14541 - protein, 266 aa, Escherichia coli EC4100B; identical to SEQ ID NO: 9078

SEQ ID NO: 14542 - protein, 747 aa, Escherichia coli EC4100B; identical to SEQ ID NO: 6343

SEQ ID NO: 14543 - protein, 446 aa, Escherichia coli EC4100B; identical to SEQ ID NO: 6459

SEQ ID NO: 14544 - protein, 246 aa, Escherichia coli EC4100B; identical to SEQ ID NO: 6342

SEQ ID NO: 14545 - protein, 866 aa, Escherichia coli EC4100B
MTIKPTKNYHNHLTRIATFCALLYCNSAFCAELVEYDHTFLMGQNASNIDLSRYSEGNPAIPGVYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGSLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEKGNVIGNVGQGGQAFVRGIEQQGNISIKWLEESKPVSCLAHYQQSSEAEKIAQSIILNGIRCQIQ

SEQ ID NO: 14546 - protein, 863 aa, Escherichia coli EC4100B
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCIANYQLPPESQQQLLTQLSAECR

SEQ ID NO: 14547 - protein, 241 aa, Escherichia coli EC4100B; identical to SEQ ID NO: 6138

SEQ ID NO: 14548 - protein, 368 aa, Escherichia coli EC4100B
MNKTITALAIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNRLAPVSSPDGVAGGFAGISNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 14549 - protein, 828 aa, Escherichia coli EC4100B; identical to SEQ ID NO: 6308

SEQ ID NO: 14550 - protein, 367 aa, Escherichia coli EC4100B; identical to SEQ ID NO: 9886

SEQ ID NO: 14551 - protein, 200 aa, Escherichia coli EC4100B; identical to SEQ ID NO: 6311

SEQ ID NO: 14552 - protein, 274 aa, Escherichia coli EC4100B; identical to SEQ ID NO: 6316

SEQ ID NO: 14553 - protein, 250 aa, Escherichia coli EC4100B; identical to SEQ ID NO: 7896

SEQ ID NO: 14554 - protein, 518 aa, Escherichia coli EC4100B; identical to SEQ ID NO: 6358

SEQ ID NO: 14555 - protein, 631 aa, Escherichia coli EC4100B; identical to SEQ ID NO: 6430

SEQ ID NO: 14556 - protein, 386 aa, Escherichia coli EC4100B; identical to SEQ ID NO: 7908

SEQ ID NO: 14557 - protein, 539 aa, Escherichia coli EC4100B; identical to SEQ ID NO: 6525

SEQ ID NO: 14558 - protein, 672 aa, Escherichia coli EC4100B; identical to SEQ ID NO: 10000

SEQ ID NO: 14559 - protein, 203 aa, Escherichia coli EC4100B; identical to SEQ ID NO: 6347

SEQ ID NO: 14560 - protein, 565 aa, Escherichia coli EC4100B; identical to SEQ ID NO: 9880

SEQ ID NO: 14561 - protein, 207 aa, Escherichia coli EC4100B; identical to SEQ ID NO: 5743

SEQ ID NO: 14562 - protein, 826 aa, Escherichia coli EC4100B; identical to SEQ ID NO: 9108

SEQ ID NO: 14563 - protein, 239 aa, Escherichia coli EC4100B; identical to SEQ ID NO: 8670

SEQ ID NO: 14564 - protein, 331 aa, Escherichia coli EC4100B; identical to SEQ ID NO: 6456

SEQ ID NO: 14565 - protein, 760 aa, Escherichia coli EC4100B; identical to SEQ ID NO: 6415

SEQ ID NO: 14566 - protein, 208 aa, Escherichia coli EC4100B; identical to SEQ ID NO: 5717

SEQ ID NO: 14567 - protein, 387 aa, Escherichia coli EC4100B
MKRKVLAMLVPALLVAGAANAAEIYNKNGNKLDLYGKVDARHTFSDNPGDDGDETIIELGFKGETQITDQLTGYGQALTKTKASDTEGSDNTYVKLAFAGLKFGEMGSFDYGRNYGVIYDVEAWTDMLPVFGGDSYTWTDNFMAGRANGVATYRNSDFFGLVEGLNFALQYQGNNEGSNAGEDQEGTKNGHEDVRFQNGDGFGLSTSYDFDFGLSLGAAYSNSDRTNSQVALGGYHYNEYGKFAGGDTAEAWTFGAKYDANNVYLAMMYAETRNMTPYGNVGIANKTQNFEAVAQYQFDFGLRPSLAYVYSKGKDLGGNDYNNNGHQEYADQDLVNYVEIGATYYFNKNFSTYVDYKINLLDKDDDFYDNNGIATDDVVGVGLVYQF

SEQ ID NO: 14568 - protein, 816 aa, Escherichia coli EC4100B; identical to SEQ ID NO: 6462

SEQ ID NO: 14569 - protein, 125 aa, Escherichia coli EC4100B
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVL

SEQ ID NO: 14570 - protein, 193 aa, Escherichia coli EC4100B; identical to SEQ ID NO: 6300

SEQ ID NO: 14571 - protein, 746 aa, Escherichia coli EC4100B; identical to SEQ ID NO: 6296

SEQ ID NO: 14572 - protein, 430 aa, Escherichia coli EC4100B; identical to SEQ ID NO: 5758

SEQ ID NO: 14573 - protein, 258 aa, Escherichia coli EC4100B
MNKRSAVTKFFTNRVTKVLGMTLALMMASQSAMASLAADQTRYIFRGDKDALTITVTNNDKTHTFGGQAWVDNIVEKDTRPTFVVTPSFFKVKPNGQQTLRIIMASDHLPKDKESVYWLNIQDIPPALEGSGIAVALRTKLKLFYRPKALLEGRKGAEEGISLQSRPDGRTMLVNTTPYIFAIGSLLDGNGKKIATDNDTAQKLLMFMPGDEVQVKGNVVKVDSLNDYGELQTWTINKKKPAAPEAAKAEKADTAEQK

SEQ ID NO: 14574 - protein, 787 aa, Escherichia coli EC4100B
MAALESGASYAGEKLDMSFIQGGAGANPDAWAALNSNYAPGRYLVELSLNGKNQGKHILDVTPEDSNDLCLTEAWLTKAGVYISADYFRKGYDATRKCYALSKAQAVKVDFDVSTQSLALTIPQKGLVKVPENIDWDYGTSAFRVNYSANANTGRHNTSAFGSADLKANIGHWVVSSSATASTGDSGDNNASINMFTATRAIRSLSADLAVGKTSTGDSLLGSTGTYGISLSRNNSMKPGNLGYSPVFSGIANGPSRVTLIQNGRILHSEMVPAGPFSITDVQLYTSGDVTMKITGEDGREQTQVFPLSVVSGQLNPGQHEFNIAAGLPDDDSHLKGGVFAASYGYGLNNLTLRAGGVFNHDWLGGSAGVVAGLSYLGAISVDGAYATAKYRDGSHNGNKVQVAWSKQLEVTNTGLRVSWAHQSEEYEDMSSFDPSKLWGEENHGRHTKDEWNMGISQPVGGLFNLSVSGWQRSYYPISGTGYSSLYSDGKDTGLTGTLSTQIKGVSLNFGVSGSRSSQGKNNWSASASVSVPFTLFDRRYSSSTSVSTSKDGGVGFSTGVSGSLNDRFSYGLGGGRDSDGSASGYFNASYSGDRAYLSGALNYSQSGGTSGSVSASGSVLAVPAARDIMFSRTSADTVAVVNVKNTPGVKVTSGNGETDKDGNLVVPLNSYDWNTVTVDAGTLPLDTELGNTSQKVVPTDKAVVWMPFDALKVHRYLLQVKQRNGEFVPGGTWARDSKKTPLGFVANNGVLMINAVDAPGDITLGQCRIPATKLRDTEKLQEITCE

SEQ ID NO: 14575 - protein, 111 aa, Escherichia coli EC4100B; identical to SEQ ID NO: 8676

SEQ ID NO: 14576 - protein, 118 aa, Escherichia coli EC4100B [sequence omitted]

SEQ ID NO: 14577 - protein, 351 aa, Escherichia coli EPECa14; identical to SEQ ID NO: 8799

SEQ ID NO: 14578 - protein, 221 aa, Escherichia coli EPECa14; identical to SEQ ID NO: 8798

SEQ ID NO: 14579 - protein, 161 aa, Escherichia coli EPECa14; identical to SEQ ID NO: 5769

SEQ ID NO: 14580 - protein, 266 aa, Escherichia coli EPECa14; identical to SEQ ID NO: 5772

SEQ ID NO: 14581 - protein, 747 aa, Escherichia coli EPECa14; identical to SEQ ID NO: 8792

SEQ ID NO: 14582 - protein, 230 aa, Escherichia coli EPECa14; identical to SEQ ID NO: 7855

SEQ ID NO: 14583 - protein, 765 aa, Escherichia coli EPECa14; identical to SEQ ID NO: 8790

SEQ ID NO: 14584 - protein, 170 aa, Escherichia coli EPECa14 [sequence omitted]

SEQ ID NO: 14585 - protein, 784 aa, Escherichia coli EPECa14; identical to SEQ ID NO: 6283

SEQ ID NO: 14586 - protein, 863 aa, Escherichia coli EPECa14
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLRREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 14587 - protein, 241 aa, Escherichia coli EPECa14; identical to SEQ ID NO: 6143

SEQ ID NO: 14588 - protein, 368 aa, Escherichia coli EPECa14; identical to SEQ ID NO: 8795

SEQ ID NO: 14589 - protein, 774 aa, Escherichia coli EPECa14; identical to SEQ ID NO: 8932

SEQ ID NO: 14590 - protein, 89 aa, Escherichia coli EPECa14; identical to SEQ ID NO: 6232

SEQ ID NO: 14591 - protein, 646 aa, Escherichia coli EPECa14
MRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRQNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 14592 - protein, 539 aa, Escherichia coli EPECa14; identical to SEQ ID NO: 6525

SEQ ID NO: 14593 - protein, 226 aa, Escherichia coli EPECa14; identical to SEQ ID NO: 7934

SEQ ID NO: 14594 - protein, 591 aa, Escherichia coli EPECa14; identical to SEQ ID NO: 7870

SEQ ID NO: 14595 - protein, 224 aa, Escherichia coli EPECa14; identical to SEQ ID NO: 7869

SEQ ID NO: 14596 - protein, 361 aa, Escherichia coli EPECa14; identical to SEQ ID NO: 7868

SEQ ID NO: 14597 - protein, 717 aa, Escherichia coli EPECa14
MAQGLSTTAASAGLITSAVMLAISPLSFLAAADKFERAKQLESYSERFKKLNYEGDALLAAFHKETGAIDAALTTINTVLSSVSAGVSAASSASLIGAPISMLVSALTGTISGILEASKQAMFEHVAEKFAARINEWEKEHGKNYFENGYDARHAAFLEDSLSLLADFSRQHAVERAVAITQQHWDEKIGELAGITRNADRSQSGKAYINYLENGGLLEAQPKEFTQQVFDPQKGTIDLSTGNVSSVLTFITPTFTPGEEVRERKQSGKYEYMTSLIVNGKDTWSVKGIKNHKGVYDYSKLIQFVEKNNKHYQARMISELGDKDDVVYSGAGSSEVFAGEGHDTVSYNKTDVGKLTIDATGASKPGEYIVSKNMYGDVKVLQEVVKEQEVSVGKRTEKIQYRDFEFRTGGIPYDVIDNLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGGIDLLDGGEGNDYLNGGFGNDIYVYRQNYGHHTIADEGGKGDRLHLSDISFDDIAFKRVGNDLIMNKAINGVLSFNESNDVNGITFKNWFAKDASGADNHLVEVITDKDGREIKVDKIPHNNNERSGYIKASNIASEKNMVNITSVANDINKIISSVSGFDSGDERLASLYNLSLHQNNTHSTTLTTTV

SEQ ID NO: 14598 - protein, 732 aa, Escherichia coli EPECa14; identical to SEQ ID NO: 8819

SEQ ID NO: 14599 - protein, 191 aa, Escherichia coli EPECa14; identical to SEQ ID NO: 5748

SEQ ID NO: 14600 - protein, 232 aa, Escherichia coli EPECa14; identical to SEQ ID NO: 5747

SEQ ID NO: 14601 - protein, 729 aa, Escherichia coli EPECa14; identical to SEQ ID NO: 8894

SEQ ID NO: 14602 - protein, 213 aa, Escherichia coli EPECa14; identical to SEQ ID NO: 5744

SEQ ID NO: 14603 - protein, 236 aa, Escherichia coli EPECa14; identical to SEQ ID NO: 6472

SEQ ID NO: 14604 - protein, 200 aa, Escherichia coli EPECa14; identical to SEQ ID NO: 6311

SEQ ID NO: 14605 - protein, 274 aa, Escherichia coli EPECa14; identical to SEQ ID NO: 7895

SEQ ID NO: 14606 - protein, 250 aa, Escherichia coli EPECa14; identical to SEQ ID NO: 8842

SEQ ID NO: 14607 - protein, 460 aa, Escherichia coli EPECa14; identical to SEQ ID NO: 8840

SEQ ID NO: 14608 - protein, 518 aa, Escherichia coli EPECa14; identical to SEQ ID NO: 6358

SEQ ID NO: 14609 - protein, 733 aa, Escherichia coli EPECa14
MAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 14610 - protein, 331 aa, Escherichia coli EPECa14; identical to SEQ ID NO: 6456

SEQ ID NO: 14611 - protein, 400 aa, Escherichia coli EPECa14
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEK

SEQ ID NO: 14612 - protein, 614 aa, Escherichia coli EPECa14; identical to SEQ ID NO: 6303

SEQ ID NO: 14613 - protein, 243 aa, Escherichia coli EPECa14; identical to SEQ ID NO: 6145

SEQ ID NO: 14614 - protein, 208 aa, Escherichia coli EPECa14; identical to SEQ ID NO: 5717

SEQ ID NO: 14615 - protein, 432 aa, Escherichia coli EPECa14; identical to SEQ ID NO: 5727

SEQ ID NO: 14616 - protein, 360 aa, Escherichia coli EPECa14; identical to SEQ ID NO: 6702

SEQ ID NO: 14617 - protein, 669 aa, Escherichia coli EPECa14; identical to SEQ ID NO: 8989

SEQ ID NO: 14618 - protein, 834 aa, Escherichia coli EPECa14
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLENVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 14619 - protein, 249 aa, Escherichia coli EPECa14; identical to SEQ ID NO: 6450

SEQ ID NO: 14620 - protein, 231 aa, Escherichia coli EPECa14; identical to SEQ ID NO: 6351

SEQ ID NO: 14621 - protein, 838 aa, Escherichia coli EPECa14; identical to SEQ ID NO: 8849

SEQ ID NO: 14622 - protein, 678 aa, Escherichia coli EPECa14; identical to SEQ ID NO: 6353

SEQ ID NO: 14623 - protein, 386 aa, Escherichia coli EPECa14; identical to SEQ ID NO: 7908

SEQ ID NO: 14624 - protein, 840 aa, Escherichia coli EPECa14
MHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYVTSGSGDLTVIIKEADGSEQRFIQPFSAVAIFQREGYLKYSLAAGEYRAGNYDSDKPHFGQFTAMYGLPWGMTAYGGALLSADYNALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 14625 - protein, 436 aa, Escherichia coli EPECa14
MKVLEKLSRLYHLTWYYDENILYIYKTNEISRSIITPTYLDIDSLLKYLRDTISVNKNSCNVRKITTFNSIEVRGVPECIKYITSLSESLDKEAQSKAKNKDVVRVFKLNYASATDITYKYRDQNVVVPGVVSILKTMASNGSLPSTGKGAVERNGNLFDNSVKISADPRLNAVVVKDREITMDIYRQLISELDIEQRQIEISVSIIDVDANDLQQLGVNWSGTLNAGQGSIAFNSSTAQANLSSSVISNANNFMIRVNALQQNSKAKILSQPSIITLNNMQAILDKNVTFYTKVSGEKVASLESITSGTLLRVTPRILDDNSNSLTGKRRERVRLLLDIQDGNQSTNQSNAQDASSILPEVQNSEMTTEATLSAGESLLLGGFIQDKESSSKDGIPLLSDIPVIGNLFSSTTKQKHSVVRLFLIKATPIKSASSE

SEQ ID NO: 14626 - protein, 430 aa, Escherichia coli EPECa14; identical to SEQ ID NO: 5758

SEQ ID NO: 14627 - protein, 816 aa, Escherichia coli EPECa14; identical to SEQ ID NO: 8806

SEQ ID NO: 14628 - protein, 243 aa, Escherichia coli EPECa14; identical to SEQ ID NO: 8805

SEQ ID NO: 14629 - protein, 193 aa, Escherichia coli EPECa14; identical to SEQ ID NO: 6300

SEQ ID NO: 14630 - protein, 746 aa, Escherichia coli EPECa14; identical to SEQ ID NO: 8803

SEQ ID NO: 14631 - protein, 222 aa, Escherichia coli EPECa14; identical to SEQ ID NO: 8943

SEQ ID NO: 14632 - protein, 869 aa, Escherichia coli EPECa14; identical to SEQ ID NO: 8801

SEQ ID NO: 14633 - protein, 355 aa, Escherichia coli EPECa14
MAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTQANGDGFGFSTTYEYEGFGVGATYAKSDRTNNQVIYGNNSLNASGQNAEVWAAGLKYDANNIYLATTYSETQNMTVFGKNHIANKAQNFEVVAQYQFDFGLRPSVAYLQSKGKDLGAWGDQDLVEYIDVGATYYFNKNMSTFVDYKINLIDKSDFTKASGVATDDIVAVGMVYQF

SEQ ID NO: 14634 - protein, 207 aa, Escherichia coli EPECa14; identical to SEQ ID NO: 5743

SEQ ID NO: 14635 - protein, 565 aa, Escherichia coli EPECa14; identical to SEQ ID NO: 6492

SEQ ID NO: 14636 - protein, 203 aa, Escherichia coli EPECa14; identical to SEQ ID NO: 6347

SEQ ID NO: 14637 - protein, 102 aa, Escherichia coli EPECa14; identical to SEQ ID NO: 6285

SEQ ID NO: 14638 - protein, 673 aa, Escherichia coli EPECa14; identical to SEQ ID NO: 8833

SEQ ID NO: 14639 - protein, 118 aa, Escherichia coli EPECa14 [sequence omitted]

SEQ ID NO: 14640 - protein, 826 aa, Escherichia coli EPECa14; identical to SEQ ID NO: 8836

SEQ ID NO: 14641 - protein, 224 aa, Escherichia coli EPECa14; identical to SEQ ID NO: 6435

SEQ ID NO: 14642 - protein, 641 aa, Escherichia coli EPECa14; identical to SEQ ID NO: 7667

SEQ ID NO: 14643 - protein, 828 aa, Escherichia coli EPECa14; identical to SEQ ID NO: 7891

SEQ ID NO: 14644 - protein, 162 aa, Escherichia coli EPECa14; identical to SEQ ID NO: 5896

SEQ ID NO: 14645 - protein, 363 aa, Escherichia coli EPECa14; identical to SEQ ID NO: 7893

SEQ ID NO: 14646 - protein, 204 aa, Escherichia coli EPECa14; identical to SEQ ID NO: 5755

SEQ ID NO: 14647 - protein, 258 aa, Escherichia coli ETEC 1392/75
MKNITFIFFILLASPLYANGDKLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLRKYQSKVKRQIFSDYQSEVDIYNRIRDEL

SEQ ID NO: 14648 - protein, 124 aa, Escherichia coli ETEC 1392/75
MNKVKYYVLFTALLSSLCAHGAPQSITELCSEYRNTQIYTINDKILSYTESMAGKREMVIITFKSGATFQVEVPGSQHIDSQKKAIERMKDTLRITYLTETKIDKLCVWNNKTPNSIAAISMEN

SEQ ID NO: 14649 - protein, 120 aa, Escherichia coli ETEC 1392/75; identical to SEQ ID NO: 5799

SEQ ID NO: 14650 - protein, 241 aa, Escherichia coli ETEC 1392/75
MTPIKLIFAALSLFPCSNIYANNITTQKFEAILGATRVIYHLDGNGESLRVKNPQDYPILIQSKVMDEGSKDNADFIVTPPLFRLDAKRETDIRIVMVNGLYPKDRESLKTLCVRGIPPKQGDLWANNEKEFVGMKLNVSINTCIKLILRPHNLPKLDINSEGQIEWGIRDGNLVAKNKTPYYFTIVNASFNGKALKTPGTLGPYEQKLYTLPSKISVSGLVKWEIIGDLGESSETKKFNI

SEQ ID NO: 14651 - protein, 72 aa, Escherichia coli ETEC 1392/75; identical to SEQ ID NO: 5964

SEQ ID NO: 14652 - protein, 236 aa, Escherichia coli ETEC 1392/75
MLSVYNRTQKFKEEARKKIAKYHELRKQRGMSLLEVIIVLGIIGTIAAGVVILAQRAFDSRAVTDLVTNTNTVRVAMKDAYQRDGKYPDFVDPLSLTANTIKTDTNGIPAAQLVQLGKITPDEVRNNISGDFIAIGGALTSNGAQVKKGFAIELNGLSQEQCRSILGQVGNNWEYVAIGTSASGSYAMTATGVDMSVAASTTVLRSLGNNGQTTLTADKILSTCTAQVNSITLGSR

SEQ ID NO: 14653 - protein, 274 aa, Escherichia coli F11
MNKTAIALLALLASSASLAATPWQKITQPVPGSAQSIGSFSNGCIVGADTLPIQSEHYQVMRTDQRRYFGHPDLVMFIQRLSRQVSNLGMGTVLIGDMGMPAGGRFNGGHASHQTGLDVDIFLQLPKTRWTSAQLLRPQALDLVSRDGKHVVPTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 14654 - protein, 715 aa, Escherichia coli F11; identical to SEQ ID NO: 6806

SEQ ID NO: 14655 - protein, 721 aa, Escherichia coli F11; identical to SEQ ID NO: 6807

SEQ ID NO: 14656 - protein, 826 aa, Escherichia coli F11
MLRMTPLASAIVALLIGIEAYAAEETFDTHFMIGGMKDQQVSNIRLEDNQPLPGQYDIDIYVNKQWRGKYEIIVKDNPQETCLSREMIKRLGINTDNFASGKQCLTFKQLIQGGSYTWDIGVFRLDFSVPQAWVEELESGYVPPENWERGINAFYTSYYVSQYYSDYKASGNSKSTYVRFNSGLNLLGWQLHSDASFSKTNNNPGGWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGHQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICQ

SEQ ID NO: 14657 - protein, 224 aa, Escherichia coli F11; identical to SEQ ID NO: 5893

SEQ ID NO: 14658 - protein, 641 aa, Escherichia coli F11
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQERDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPELKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 14659 - protein, 828 aa, Escherichia coli F11; identical to SEQ ID NO: 5895

SEQ ID NO: 14660 - protein, 162 aa, Escherichia coli F11; identical to SEQ ID NO: 5896

SEQ ID NO: 14661 - protein, 367 aa, Escherichia coli F11; identical to SEQ ID NO: 5906

SEQ ID NO: 14662 - protein, 200 aa, Escherichia coli F11
MLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFNLYSSNTVRTIQSATWFSAGKKLTVDKRFLQCGNEIYSAIKDLQRKAPDKNIVIFTHNHCLTYIAKDKRDATFKPDYLDGLVMHVEKGKVYLDGEFVNH

SEQ ID NO: 14663 - protein, 660 aa, Escherichia coli F11; identical to SEQ ID NO: 6257

SEQ ID NO: 14664 - protein, 878 aa, Escherichia coli F11
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTSWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 14665 - protein, 216 aa, Escherichia coli F11
MAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALSPDQAAEKLRFRRSANSLTLINPTPYYLTVTELNAGTRVLENALVPPMGESAVKLPSDAGSNITYRTINDYGALTPKMTGVME

SEQ ID NO: 14666 - protein, 368 aa, Escherichia coli F11; identical to SEQ ID NO: 7561

SEQ ID NO: 14667 - protein, 1024 aa, Escherichia coli F11; identical to SEQ ID NO: 7555

SEQ ID NO: 14668 - protein, 241 aa, Escherichia coli F11; identical to SEQ ID NO: 7582

SEQ ID NO: 14669 - protein, 844 aa, Escherichia coli F11; identical to SEQ ID NO: 7553

SEQ ID NO: 14670 - protein, 836 aa, Escherichia coli F11
MKDRIPFAVNNITCVILLSLFCNAASAVEFNTDVLDAADKKNIDFTRFSEAGYVLPGQYLLDVIVNGQSISPASLQISFVEPALSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVMTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 14671 - protein, 244 aa, Escherichia coli F11
MWELSMIRKKILMAAIPLFVISGADAAVSLDRTRAVFDGSEKSMTLDISNDNKQLPYLAQAWIENENQEKIITGPVIATPPVQRLEPGAKSMVRLSTTPDISKLPQDRESLFYFNLREIPPRSEKANVLQIALQTKIKLFYRPAAIKTRPNEVWQDQLILNKVSGGYRIENPTPYYVTVIGLGGSEKQAEEGEFETVMLSPRSEQTVKSANYNTPYLSYINDYGGRPVLSFICNGSRCSVKKEK

SEQ ID NO: 14672 - protein, 203 aa, Escherichia coli F11; identical to SEQ ID NO: 7450

SEQ ID NO: 14673 - protein, 656 aa, Escherichia coli F11
MRLKKRYLCTVLSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYHDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 14674 - protein, 565 aa, Escherichia coli F11; identical to SEQ ID NO: 5881

SEQ ID NO: 14675 - protein, 539 aa, Escherichia coli F11; identical to SEQ ID NO: 7564

SEQ ID NO: 14676 - protein, 432 aa, Escherichia coli F11; identical to SEQ ID NO: 5727

SEQ ID NO: 14677 - protein, 505 aa, Escherichia coli F11
MYKKTTLAVLIALLTGATTVHAQTDISSIESRLAALEQRLKNAESRAQAAEARAKTAELQVQKLAETQQQNQLTTQEVAQRTVQLEQKSAENSGFEFHGYARSGLLMNDAASSSKSGPYLTPAGETGGAVGRLGNEADTYVELNVEHKQTLDNGATTRFKAMLADGQRDYNDWTGGSSNLNIRQAFAELGALPSFTGAFKDSTVWAGKRFDRDNFDIHWLDSDVVFLAGTGGGIYDVKWNDTFRSNFSLYGRNFGDLDDIDNNVQNYILTMNHYAGPFQLMVSGLRAKDNDDRKDANGDLIQTDAANTGVHALVGLHNDTFYGLREGTAKTALLYGHGLGAEVKGIGSDGALLSEANTWRFASYGTTPLGSGWYVAPAILAQSSKDRYVKGDSYEWVTFNTRLIKEVTQNFALAFEGSYQYMDLKPKGYQNHNAVNGSFYKLTFAPTLKANDINNFFSRPELRLFATWMDWSSKLDDFASNDAFGSSGFNTGGEWNFGVQMETWF

SEQ ID NO: 14678 - protein, 231 aa, Escherichia coli F11; identical to SEQ ID NO: 6256

SEQ ID NO: 14679 - protein, 725 aa, Escherichia coli F11; identical to SEQ ID NO: 6241

SEQ ID NO: 14680 - protein, 351 aa, Escherichia coli F11
MKKSTLALVVMGIVASVSVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLESDNKLNINNDDIVAVGMTYQF

SEQ ID NO: 14681 - protein, 654 aa, Escherichia coli F11; identical to SEQ ID NO: 8265

SEQ ID NO: 14682 - protein, 250 aa, Escherichia coli F11
MKCIIGNKKWVYGFRDELKVSQNIIRSGILFLLSILFINNASAGGFGLGVTRLIYPAESKQITLSVQNSGDNTSYLIQSWVDDSKTEKKSQDFVITPPLFMLPTRKEASLRIMFLGKTNLPTDRETLYWMNVKAIPPTDEKNTQKNTLQLALQNKIKLFYRPENLPVQPGKARNMLRFKYEGKQLKVINPSPYYLTLTGIKVQGSKLPNMFVPPKSDITVSSPVTLAGEITYQTINDFGATTERQKGIMQ

SEQ ID NO: 14683 - protein, 259 aa, Escherichia coli F11
MRQYRLLSPMIKVVIVLFSLLFSTAQAGLVIGGTRFAYPENQSSISVELKNTSDRDMLVKVAVSPDDARQLTGTVESLPSYSETVFIATPPLFVLKPDKNTKIRINRVGGSLPADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDIYNNVLPAWKVNMNLLQMDVSGSQVKTD

SEQ ID NO: 14684 - protein, 412 aa, Escherichia coli F11; identical to SEQ ID NO: 11006

SEQ ID NO: 14685 - protein, 783 aa, Escherichia coli F11
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPGSCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIANGFQASKAYSANSIVDYNDAHYKTSVDQDAWGFVPGGDNPWKKYEPAKAWSASTVYVKGDRVVVDGQAYEALFWTQSDNPALVANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAIVNDG

SEQ ID NO: 14686 - protein, 686 aa, Escherichia coli F11; identical to SEQ ID NO: 7831

SEQ ID NO: 14687 - protein, 836 aa, Escherichia coli F11
MKKNKSTFTINFITYSLMLSLAGVPVYAVDFNTDVLDAADRQNIDFSRFSRAGYIMPGQYQMEIRVNGQDISPSAFQIAFLEPPFSDSDNEKPLPEPCLTPEIVSRMGLTEASQEKVTYWNNGQCADFRQLSGVEIRPNPAEGMLYINMPQAWLEYSDASWLPPSRWDNGIPGLLFDYNINGTVNKPHQGKQSQSLNYNGTAGANFGAWRLRADYQGNLNHTTGSAQGTDSQFTWSRFYMYRAIPRWRANLTLGENYINSEIFSSWRYTGASLESDDRMLPPKLRGYAPQVSGIADTNARVVISQQGRILYDSTVPAGPFTIQDLDSSVRGRLDVEVIEQDGRKKTFQVDTAYVPYLTRPGQVRYKLVSGRSRTYEHTMEGPVFAAGEASWGISNTWSLYGGSIVAGDYNALAVGLGRDLSKFGTVSADVTQSVARIPGYDTKQGKSWRLSYSKRFDEVNTDITFAGYRFSERNYMTMDQYLNARYRNDFTGREKELYTVTLNKNFEDWKASVNLQYSHQTYWDRRTSDYYTLSVNRYFDAFSFKNIALGISASRSKYLNRDNDSAFVRLSVPWGTGTASYSGSMSNDRYTNTVGYSDTLNNGLSSYSLNAGVNSGGGQPSQRQMSAYYNHNGSLTNLSASFSAVENGYSSFGMSASGGATVTMKGAALHAGGMNGGTRLLVDTDGVGGVPVDGGRVYTNRWGIGVVTDVSSYYRNTTSVDLNKLPEDMEATRSVVESVLTEGAIGYREFEVLKGSRLFAVLRMSDNSYPPFGASVTNAKGRELGMVADSGLAWLSGVNPGETLNVGWDGRTQCVVDIPAHPDPAQQLLLPCRQVK

SEQ ID NO: 14688 - protein, 243 aa, Escherichia coli F11; identical to SEQ ID NO: 6167

SEQ ID NO: 14689 - protein, 359 aa, Escherichia coli F11
MKKYLALALIAPLLISCSTTKKGDTYNEAWVKDTNGFDILMGQFAHNIENIWGFKKVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 14690 - protein, 446 aa, Escherichia coli F11
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQKNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYTGSSSTNPYYGKAVSADFNGGSFGRGDSDEWTFGAQMEIWW

SEQ ID NO: 14691 - protein, 260 aa, Escherichia coli F11; identical to SEQ ID NO: 6790

SEQ ID NO: 14692 - protein, 478 aa, Escherichia coli F11; identical to SEQ ID NO: 6796

SEQ ID NO: 14693 - protein, 203 aa, Escherichia coli F11; identical to SEQ ID NO: 6414

SEQ ID NO: 14694 - protein, 362 aa, Escherichia coli F11; identical to SEQ ID NO: 5874

SEQ ID NO: 14695 - protein, 678 aa, Escherichia coli F11
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQSVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGPVLQQKFGSTSELRAGVNGGSGIALTGSPITPRETTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 14696 - protein, 771 aa, Escherichia coli F11
MRRVDGDHARQLQFVAKMQEKTMNKKIHSLALLVNLGIYGVALPVLAEETSDNAVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQSLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 14697 - protein, 517 aa, Escherichia coli F11; identical to SEQ ID NO: 6817

SEQ ID NO: 14698 - protein, 191 aa, Escherichia coli F11
MNKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDELDITGDLTLNGVTKPVTLEAKLIGQGDDPWGGKRAGFEAEGKIKLKDFNIKTDLGPASQEVDLIISVEGVQQK

SEQ ID NO: 14699 - protein, 232 aa, Escherichia coli F11; identical to SEQ ID NO: 5747

SEQ ID NO: 14700 - protein, 711 aa, Escherichia coli F11
MFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNIPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 14701 - protein, 518 aa, Escherichia coli F11; identical to SEQ ID NO: 7565

SEQ ID NO: 14702 - protein, 614 aa, Escherichia coli F11
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDNTRVTLLGDYAHTHGYDVVAYGNTGTQAQPDNDGFLSKTLYGALEHNFTDVWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGSYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 14703 - protein, 161 aa, Escherichia coli F11; identical to SEQ ID NO: 5769

SEQ ID NO: 14704 - protein, 266 aa, Escherichia coli F11; identical to SEQ ID NO: 7500

SEQ ID NO: 14705 - protein, 747 aa, Escherichia coli F11; identical to SEQ ID NO: 7499

SEQ ID NO: 14706 - protein, 246 aa, Escherichia coli F11
MFFNTKHTAALCLASCMAFSSSAIADIVISGTRVVYKSEQKNVNVRLENKGNNPLLVQSWLDTGDDNAEPGSITVPFTATPPVSRIDAKRGQTIKLMYTASSALPKDRESVFWFNVLEVPPKPDAAKAANQSLLQLAFRTRIKLFYRPEGLSGISSDAPLALKWSWATSEGKAALRVDNPTPYYVSFSSGDLEANGKRYPLDMTMIAPFSNDVIKVNGMSGRTSSAKVHFFAINDFGGSIEGNANL

SEQ ID NO: 14707 - protein, 790 aa, Escherichia coli F11
MSQSIAFAVIEGKKNAQACITQKNLLQFHISSPDKNSEKAILLKRDEDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQELEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNTTSEKIAQSIILNGLRCQIQ

SEQ ID NO: 14708 - protein, 236 aa, Escherichia coli F11
MQTTRTPYSVSFMATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTHLAMAPEEAPAMLRFRRSGSKFTLINPTPYFITVTNMKAGNSNLPNTMVPPKGEVSVDIPHAVTGDISFQTINDYGALTPRIKATMQ

SEQ ID NO: 14709 - protein, 871 aa, Escherichia coli F11
MHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTQGGNTSSGTSGYSSLNYRGAYGNTNVGYSRSGDSSQIYYGMSGGIIAHADGITFGQPLGDTIVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPAVSPGTLLNQQTAICR

SEQ ID NO: 14710 - protein, 700 aa, Escherichia coli F11
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTQRGELGVPVTFTTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMAFASIGYIPEDGWYAGTEARYMGDIMADDENTAKAPSYTLVGLFTGYKYNYHNFTVDLFGRVDNLFDKEYVGSVIVNESNGRYYEPAPGRNYGVGINIAWRFE

SEQ ID NO: 14711 - protein, 118 aa, Escherichia coli F11 [sequence omitted]

SEQ ID NO: 14712 - protein, 213 aa, Escherichia coli F11; identical to SEQ ID NO: 5744

SEQ ID NO: 14713 - protein, 380 aa, Escherichia coli F11; identical to SEQ ID NO: 7505

SEQ ID NO: 14714 - protein, 360 aa, Escherichia coli F11; identical to SEQ ID NO: 5891

SEQ ID NO: 14715 - protein, 119 aa, Escherichia coli F11; identical to SEQ ID NO: 5803

SEQ ID NO: 14716 - protein, 760 aa, Escherichia coli F11
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEDYWVADAKLGYRVNRNLDFQLNVYNLFDTDYVASINKSGYRYHPGEPRTFLLTANMHF

SEQ ID NO: 14717 - protein, 250 aa, Escherichia coli F11
MSYKLSCPMLVSTALMALLTTASLTAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRKPWQFKVTLTRSGQDYTVNNPTPYHVIISDASTQKKGLTAAGFKPLVMPPKTSQPLKAKMASAPVLTYINDYGARMPLIFRCEGNTCKVDEDQSSKG

SEQ ID NO: 14718 - protein, 882 aa, Escherichia coli F11
MPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKHWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGGGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 14719 - protein, 208 aa, Escherichia coli F11
MKKIWLALAGLVLAFSASAAQYEDGKQYTTLEKQVAGAPQVLEFFSFFCPHCYQFEEVLHISDNVKKKLPEGVKMTKYHVNFMGGDLGKELTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSNMDVFVQQYADTVKYLSEKK

SEQ ID NO: 14720 - protein, 193 aa, Escherichia coli F11; identical to SEQ ID NO: 6300

SEQ ID NO: 14721 - protein, 673 aa, Escherichia coli F11; identical to SEQ ID NO: 6170

SEQ ID NO: 14722 - protein, 103 aa, Escherichia coli F11
MCATKRTVIRPAWIWNTWNQTGLELGWFKQQNKTQQGVTLNESAYKTTLWHALKVGESILGSRPEIRFYGTYINILDNELSNFKFNENSKDEFMAGIQAEVWW

SEQ ID NO: 14723 - protein, 421 aa, Escherichia coli F11
MRSVIVAFLFACSFCVSAETVNLNNSSVRSFVQWYSSKTGKPVIVNPDIKGNVTVFNADVNPTNIDDFFKSVLNANGFVMLSGNPAVVSLPSKLPSQMVSDSDDSDNQSYDTFPSEPSYQPVPVALTVRNFKLTKVRSSDVQQLIKIYLDSNGGGNVVDYPGNNSLIVSAPDELLPVLSDFINSVDVARDQVLIQSLMFETSLSDGVDLSFAAGSASGHKVAGGFNTSALGSALSTAGGSFGIFDGNVLALSLRAVQSNSRSKVISTPRILTQSGQTGYISVGKNVPFITGKVTGESAGVNNPFQTIERHDVGVSLKVTPVVMGNGQLVLTIDTRADSISNDDQASDIITNQRQIQTTVQIKDGQTLLLGGLIDSSFSNAERSVPVISKIPLIGWIFSSKADSNEQRIMYILLTAHIIRPL

SEQ ID NO: 14724 - protein, 111 aa, Escherichia coli F11; identical to SEQ ID NO: 5889

SEQ ID NO: 14725 - protein, 656 aa, Escherichia coli F11; identical to SEQ ID NO: 7573

SEQ ID NO: 14726 - protein, 753 aa, Escherichia coli F11; identical to SEQ ID NO: 5801

SEQ ID NO: 14727 - protein, 331 aa, Escherichia coli F11; identical to SEQ ID NO: 8190

SEQ ID NO: 14728 - protein, 72 aa, Escherichia coli F18+; identical to SEQ ID NO: 5952

SEQ ID NO: 14729 - protein, 119 aa, Escherichia coli F18+; identical to SEQ ID NO: 5985

SEQ ID NO: 14730 - protein, 816 aa, Escherichia coli FVEC1302
MLRTTRWVAAIIFLYSFPGYAEETFDTHFMIGGMRGEKVSEYRFDNKQPLPGNYELDVYVNHQWRGKQDITIPESPAKPCLPKVLLTTLGVKTDNLNTEDNCILLDEAVHGGQYQWDISEHRLNLTIPQAYINELERGYVPPESWDRGIDAFYTSYNLSQYRSYDSNNNSNTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYTIYQKEVPPGPFTIADLQLSGSGSDLDVSIKEADGSVRSFLVPYSSVPNMLQPGVSNFDFIAGRSQIYGVKNQEDFLEANYIYGLNNLLTLYGGTILSDNYNAITLGNGWNTPLGAISFDATRSSSKLNNDTRHEGTSYQVAYNKYLLQTATHFSVAAWRYASQDYRTFSDHLYENDKINHQSDDDDFYDIGRKNSLSANIMQPLSNNLGNVSLSALWRNYWGRSGNAKDYQFSYSNSWQRISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPIATIDGSYSHSKNAWQSGGSISSGLVVWPGGINITNQLSDTFAILDAPGLEGAHINGQKYNRTNSKGQVVYDLMIPHRENHLVLDIANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 14731 - protein, 227 aa, Escherichia coli FVEC1302; identical to SEQ ID NO: 8084

SEQ ID NO: 14732 - protein, 784 aa, Escherichia coli FVEC1302; identical to SEQ ID NO: 6283

SEQ ID NO: 14733 - protein, 170 aa, Escherichia coli FVEC1302; identical to SEQ ID NO: 5855

SEQ ID NO: 14734 - protein, 866 aa, Escherichia coli FVEC1302
MKTKTSTKRHNLTRIAMYCSIMYSGATIGAESVEYDPTFLMGGNASSIDVSRYSDGNPTLPGVYDVSIYVNEQPVANLEIPFIAIPDKKNAQACITLKNLLQLHIKTPPADEENTILLPRDETLGNCLDLSLAIPKSSVNYDPSEQRLDINVPQAWVMKNYQNYVDPSLWENGINAATLSYNINAYRSENSNYTNDSVYTSFNGGVNLGAWRLRSSGNYSWRNDAGSNVEFMNRYVQRDITAIRSQLIMGESYTTGETFDSVSIRGIRLYSDSRMLPPVLANFAPTIRGVANTNAKVSITQSGYKIYETTVPPGPFVIDDLSPSGYGSDLIVTIEEADGSKRTFSQPFSSVIQMLRPGVSRWDISGGQINKDDLHHEPNLLQATYYRGLSNLFTGYTGFQVTDNHYAAGLLGIGMNTSVGAISFDVTHSSVDIPDDKRYQGQSYRISWNKFFDLTDTSLNIAAYRYSTQDYLGLNDALTLIDEVEHPTQDLDPKTMRNYGRMKNQFTVSINQPLRFGKDDYGSFYTSGSWSDYWGGSKSRSNYSVGYSNSASWGSYSISAQRSWDEYSQTENSIYLSFSIPIEKLMGTEHRDSGFQSIDTQLSTNMDGNNQFNMSSSGYSNDNRVSYSVNAGYGMNKTGKDLSNIGGYASYESPWGTLAGSVSATSDNNRQYSVNTDGGFVLHSGGLTFSNDSFSDNDTIALVKAPGAKGARINYGNNTVDRWGYGVTSALSPYQENKIALDTENLENDIEMKSTSTVAVPRQGSVIFAGFETNQGQSAIMNIKRSDGKGIPFAADIHDETNAIIGNVGQGGQAFVRGIQQQGTIKITWLEASMPKTCIAQYQQPNVTSEKIQQTIILNNILCQLQ

SEQ ID NO: 14735 - protein, 243 aa, Escherichia coli FVEC1302
MLNKKNIVALCVASSMAFSMPVMADIVISGTRVIYKSDQKSVSVRLENKGNSHLLVQSWLDTGDDNAEPGSINVPFTATPPVSRIDAKRGQTIKLMYTGSTVLPSDKESVFWFNVLEVPPKPDASKVENQSLLQLAFRTRIKLFYRPAGLNGNPSEAPLALKWKWAEGKSGLSVYNPTSYYVSFNSAELIAGGKSNPLNVKMVAPKSEEIFTISGSGGKATSGKVHFSAINDFGGAIEGDVNL

SEQ ID NO: 14736 - protein, 752 aa, Escherichia coli FVEC1302; identical to SEQ ID NO: 7439

SEQ ID NO: 14737 - protein, 266 aa, Escherichia coli FVEC1302; identical to SEQ ID NO: 8089

SEQ ID NO: 14738 - protein, 161 aa, Escherichia coli FVEC1302; identical to SEQ ID NO: 5769

SEQ ID NO: 14739 - protein, 446 aa, Escherichia coli FVEC1302; identical to SEQ ID NO: 6459

SEQ ID NO: 14740 - protein, 237 aa, Escherichia coli FVEC1302; identical to SEQ ID NO: 6384

SEQ ID NO: 14741 - protein, 478 aa, Escherichia coli FVEC1302
MTRIKINARRIFSLLIPFFFFTSVHAEQTATPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQERKNGLLSQ

SEQ ID NO: 14742 - protein, 774 aa, Escherichia coli FVEC1302; identical to SEQ ID NO: 6382

SEQ ID NO: 14743 - protein, 368 aa, Escherichia coli FVEC1302; identical to SEQ ID NO: 6380

SEQ ID NO: 14744 - protein, 241 aa, Escherichia coli FVEC1302; identical to SEQ ID NO: 6143

SEQ ID NO: 14745 - protein, 878 aa, Escherichia coli FVEC1302; identical to SEQ ID NO: 6669

SEQ ID NO: 14746 - protein, 119 aa, Escherichia coli FVEC1302
MNTVLSVQGASAPVKKKSFFSKFTRLNMLRLVRAVIPVAVLMMLFPELAMAAGKGDLMAKGQETVKATFGKNSSIVKWIVLAEVLVGAVMYMMTKNIKFLVGFAILSVFIAVGMSVAGF

SEQ ID NO: 14747 - protein, 221 aa, Escherichia coli FVEC1302; identical to SEQ ID NO: 6115

SEQ ID NO: 14748 - protein, 351 aa, Escherichia coli FVEC1302; identical to SEQ ID NO: 5767

SEQ ID NO: 14749 - protein, 230 aa, Escherichia coli FVEC1302
MMTKIKLLMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPYTLKFSRSGNYINVHNPSPFYVTLVNLQVGSQKLGNAMAAPRVNSQIPLPSGVQGKLKFQTVNDYGSVTPVREVNLN

SEQ ID NO: 14750 - protein, 869 aa, Escherichia coli FVEC1302
MKIPTTTDIPQRYTWCLAGICYSSLAILPSFLSYAESYFNPAFLLENGTSVADLSRFERGNHQPAGVYRVDLWRNDEFIGSQDIVFESTTVNTGDKSGGLMPCFNQALLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 14751 - protein, 360 aa, Escherichia coli FVEC1302; identical to SEQ ID NO: 5879

SEQ ID NO: 14752 - protein, 746 aa, Escherichia coli FVEC1302; identical to SEQ ID NO: 8052

SEQ ID NO: 14753 - protein, 193 aa, Escherichia coli FVEC1302; identical to SEQ ID NO: 6300

SEQ ID NO: 14754 - protein, 243 aa, Escherichia coli FVEC1302
MTFMKGLPLLLLIASLCSYAALQPDRTRIVFNANDKATSLRVDNRSDKLPYLAYSWLENEKGEKSDDLLVALPPIQRLEPKATTQVRIVKQASTAKLPGDRETLFFYNMREIPPSPEKNSGHAVLQVAIQSRIKVFWRPSALRKKAGEKVELQLQVSQQGNQLNLKNPTGYYLTIAYLGRNEQGVLPGFKTVMVAPFSTVITNTGSYSGSQFYLGYMDDYGALRMTTLNCNGHCRLQAVEAKK

SEQ ID NO: 14755 - protein, 816 aa, Escherichia coli FVEC1302
MNIYRLSFISCLVMAIPSALAVEFNLNVLDKSMRDRIDISLLKGKGGIAPGEYFVSVAVNNNQISNGQKIDWKKNGDQTIPCINDLLVDKFGLKPEVRQSLPRLNQCVDFSSRPEILFIFDQASQQLNITIPQAWLAWHSDNWTPPSTWKEGVAGVLMDYNLFASSYRPQDGSNSTNLNAYGTAGINAGAWRLRSDYQLNQTDSDDNHEQSGEISRTYLFRPLPQLGSKLTLGETDFSSNIFDGFSYTGAALASDDRMLPWELRGYAPQISGIAQTNATVTVSHSGRVIYQKKVPPGPFIIDDLNQSVQGTLDVKVTEEDGRVNNFQVSAASTPFLTRQGQVRYKLAAGQPRTSMSHQTENETFFSNEVSWGMLSNTSLYGGLLISGDNYHSAAMGIGQNMLWLGALSFDVTWASSQFDTQQDERGLSYRFNYSKQVDATNSTISLAAYRFSDRHFHSYANYLDHKYNDNDAQDEKQTISLSVGQPITPLNLNLYANLLHQTWWNADASTTANITAGFNVDIGNWRDISISTSFNTTHYEDKDRDNQIYLSISLPFGNGGRVGYDMQNSNHSTTHRMSWNDTLDERNSWGMSTGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVADNVIKETWIEGAIGYKSLASRSGKDVNLIIRNASGQFPPLGADIRQEDSGISVGMVGEEGHAWLSGVAENQQFTVIWGDSQRCSIHLPEHMEDTANRLILPCH

SEQ ID NO: 14756 - protein, 430 aa, Escherichia coli FVEC1302; identical to SEQ ID NO: 5758

SEQ ID NO: 14757 - protein, 331 aa, Escherichia coli FVEC1302; identical to SEQ ID NO: 6551

SEQ ID NO: 14758 - protein, 760 aa, Escherichia coli FVEC1302; identical to SEQ ID NO: 8074

SEQ ID NO: 14759 - protein, 203 aa, Escherichia coli FVEC1302; identical to SEQ ID NO: 6414

SEQ ID NO: 14760 - protein, 362 aa, Escherichia coli FVEC1302; identical to SEQ ID NO: 5813

SEQ ID NO: 14761 - protein, 517 aa, Escherichia coli FVEC1302; identical to SEQ ID NO: 6817

SEQ ID NO: 14762 - protein, 191 aa, Escherichia coli FVEC1302
MKKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDDLDITGDLTLNGVTKPVTLEAKLIGQGDDPWGGKRAGFEAEGKIKLKDFNIKTDLGPASQEVDLIISVEGVQQK

SEQ ID NO: 14763 - protein, 232 aa, Escherichia coli FVEC1302; identical to SEQ ID NO: 5747

SEQ ID NO: 14764 - protein, 729 aa, Escherichia coli FVEC1302; identical to SEQ ID NO: 8069

SEQ ID NO: 14765 - protein, 213 aa, Escherichia coli FVEC1302; identical to SEQ ID NO: 5744

SEQ ID NO: 14766 - protein, 203 aa, Escherichia coli FVEC1302; identical to SEQ ID NO: 6347

SEQ ID NO: 14767 - protein, 656 aa, Escherichia coli FVEC1302
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEANLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTITAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 14768 - protein, 565 aa, Escherichia coli FVEC1302
MKSPAPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQNEVAMDISWHFLTNVQHTYDREKKLVEKYDVSTTGTGGGGGEYPLQDGFGWTNGVTLKMLDLICPKEQPCDNVPATRPLSESTTQPVKQKEAEPTP

SEQ ID NO: 14769 - protein, 205 aa, Escherichia coli FVEC1302; identical to SEQ ID NO: 8627

SEQ ID NO: 14770 - protein, 118 aa, Escherichia coli FVEC1302 [sequence omitted]

SEQ ID NO: 14771 - protein, 402 aa, Escherichia coli FVEC1302
MKIIITREYIMKRKVLAMLVPALLVAGAANAAEVYNKDGNKLDLYGKVAGLHYFSDDAGSDGDMSYARIGFKGETQIADQFTGYGQWEFNIGANGPESDKGNTATRLAFAGLGFGQNGTFDYGRNYGVVYDIEAWTDMLPEFGGDTYAGADNFMNGRANGVATYRNNGFFGQVDGLNFALQYQGNNEDDGLFGQEGSGNGNGRKLAKENGDGFGMSTSYDFDFGLSLGAAYSNSDRTDNQVHKGWHNTRDGDRSDTTAGGETAEAWTVGAKYDANNVYLAAMYAETRNMTGYGKADAIANKTQNFEVVAQYQFDFGLRPSIAYLQSKGKDLGGWAHDGNGDPRYTNKDLVKYVDIGATYYFNKNMSTYVDYKINLLDNDDDFYEANGIATDDIVAVGLVYQF

SEQ ID NO: 14772 - protein, 551 aa, Escherichia coli FVEC1302; identical to SEQ ID NO: 5742

SEQ ID NO: 14773 - protein, 673 aa, Escherichia coli FVEC1302; identical to SEQ ID NO: 6170

SEQ ID NO: 14774 - protein, 518 aa, Escherichia coli FVEC1302; identical to SEQ ID NO: 6358

SEQ ID NO: 14775 - protein, 700 aa, Escherichia coli FVEC1302
MKIFSVRQTVLPALLVLSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVITQTGQQPPTIEASSYYGSFGSWRYGLKATGAMGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQAAELAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGMNIAWRFE

SEQ ID NO: 14776 - protein, 366 aa, Escherichia coli FVEC1302; identical to SEQ ID NO: 7432

SEQ ID NO: 14777 - protein, 236 aa, Escherichia coli FVEC1302
MQTTRTPYSISFMATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 14778 - protein, 826 aa, Escherichia coli FVEC1302; identical to SEQ ID NO: 8096

SEQ ID NO: 14779 - protein, 224 aa, Escherichia coli FVEC1302
MKGLLALLISSMVLPAHAGIVIYGTRIIYPAEHKEVMVQLMNQGNRSSLLQAWIDDGDTSLPPEKIQVPFMLTPPVAKIGENSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSINVKSNNANNWYLTIIDDHGNYISDKI

SEQ ID NO: 14780 - protein, 659 aa, Escherichia coli FVEC1302
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGDTPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 14781 - protein, 111 aa, Escherichia coli FVEC1302; identical to SEQ ID NO: 8631

SEQ ID NO: 14782 - protein, 828 aa, Escherichia coli FVEC1302; identical to SEQ ID NO: 6558

SEQ ID NO: 14783 - protein, 162 aa, Escherichia coli FVEC1302; identical to SEQ ID NO: 5896

SEQ ID NO: 14784 - protein, 367 aa, Escherichia coli FVEC1302
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSVAYLQSKGKNLGTIGTRNYDDEDILKYVDVGATYYFNKNMSTYVDYKINLLDDNQFTRDAGINTDNIVALGLVYQF

SEQ ID NO: 14785 - protein, 200 aa, Escherichia coli FVEC1302; identical to SEQ ID NO: 7474

SEQ ID NO: 14786 - protein, 274 aa, Escherichia coli FVEC1302; identical to SEQ ID NO: 8098

SEQ ID NO: 14787 - protein, 249 aa, Escherichia coli FVEC1302; identical to SEQ ID NO: 8118

SEQ ID NO: 14788 - protein, 879 aa, Escherichia coli FVEC1302
MPEHSFLRLRGLSWWIALAISGSPFNALADDTIQFDGRFLDLKGNTKIDLGRFSQKGYVEPGKYNLRVHVNNQPLPDDYDIYWYATENDPNKSYACLSPELVAQFGLKEDIAKNLQWIRDGQCLNTALLAGTEISGDLGQSALLVSVPQAYLEYTDSEWDPPSRWDDGIPGLIADYSINAQTRHENGGDDTNDISGNGTVGVNVGPWRLRADWQSDYQHTRSNDDGDTDDSGTQKNWEWSRYYAWRALPSLKAKLSLGEDYLNSDIFDGFSYIGGSISTDDQMLPPNLRGYAPDISGVAHTTAKVTVTQMGRVIYETQVPAGPFRIQDIGDSVSGTLHVRIEEQNGQVQEYDVSTASMPFLTRPGQVRYKVTMGRPQNWDHQVAGSFFSGGEASWGIANGWSLYGGALADENYQSAALGLGRDLALLGALAFDVTHSRVQLDDNSVYGNKTLDGNSYRVSYAKDFDELNSRVTFAGYRFSEKNYMTMSEYLDANDDDRARTGNDKEMYTVTYNQNFTDARVSVYLNYSHHTYWDRQDQTNYNMMLSHYFNLGSLRNLSVSLTGYRYEYDKSADKGVYLSLSLPWGDNSTISYNGNYGSGADSNQVSLYHRIDDASHYTVSAGTSENHSSVDGYYSHDGTLAKVDLSANYHEGQYTSAGISLQGGATLTAHGGALHRTQNMGGTRLLIDADGVANVPVEGNGSAVYTNMFGKAVVADVNDYYRNQAYIDLNKLPENAEATKSVVQATLTEGAIGYRKFAVISGEKAMAVLRLQDGSHPPFGAEVKNDNQQQVGLVDDEGNVYLAGVKPGEHMTVFWEGESHCDISLPDPLPNDLFNGLLLPCQQKGGSSPVIPHDIQPVIQEQTQQVTPMEPPMSVSSNQ

SEQ ID NO: 14789 - protein, 567 aa, Escherichia coli FVEC1302; identical to SEQ ID NO: 6075

SEQ ID NO: 14790 - protein, 359 aa, Escherichia coli FVEC1302; identical to SEQ ID NO: 6332

SEQ ID NO: 14791 - protein, 244 aa, Escherichia coli FVEC1302; identical to SEQ ID NO: 6219

SEQ ID NO: 14792 - protein, 843 aa, Escherichia coli FVEC1302
MNLVMRGMKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 14793 - protein, 696 aa, Escherichia coli FVEC1302
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTAGSRYEHHEQFGGHFSPRAYLVWDVADAWTLKGGVTTGYKAPRMGQLHKGISGVSGQGKTNLLGNPNLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 14794 - protein, 732 aa, Escherichia coli FVEC1302
MMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLRQELVGQVYYRDESLRFYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 14795 - protein, 432 aa, Escherichia coli FVEC1302; identical to SEQ ID NO: 5727

SEQ ID NO: 14796 - protein, 222 aa, Escherichia coli FVEC1302
MSKLGISSLFKTILLTAALAVSFTASAFTEGTDYMVLEKPIPNADKTLIKVFSYACPFCYKYDKAVTGPVSEKVKDIVAFTPFHLETKGEYGKQASEVFAVLINKDKAAGISLFDANSQFKKAKFAYYAAYHDKKERWSDGKDPAAFIKTGLDAAGMSQADFEAALKEPAVQETLEKWKASYEVAKIQGVPAYVVNGKYLIYTKSIKSIDSMADLIRELASK

SEQ ID NO: 14797 - protein, 678 aa, Escherichia coli FVEC1302
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALMLPLNGQAAVFGRTIQQGFEAAKNIGTQPVAAQVAAAPAADVAEQPQPQTVDGVASPAQASVSDLTGEQPAAQPVPVSAPAATTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSHSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 14798 - protein, 259 aa, Escherichia coli FVEC1302
MHQFPLSSLMINVLICILICCTNAQAGVVVGGTRFVYPEKQSSISVELKNTASKDMLVKISVTPDDGRQLKGTLESQPLLPDKAFIATPPLLVLKQDKNTKIRINRVGGQLPIDRESLFILNIAVLPAQEQNSQLKNENQLQVAVRNRMKIFYRPETLSGNPLDAYQQLRWSRNNEAVTVFNPTPWYVTLYNLSIDGKSINGGMVAPFSHRQQDWCQRQGYCEINWQTLDLYNNALPVWSVKLNVLQNNAIMGAVAIHG

SEQ ID NO: 14799 - protein, 250 aa, Escherichia coli FVEC1302; identical to SEQ ID NO: 6119

SEQ ID NO: 14800 - protein, 243 aa, Escherichia coli FVEC1302
MSRKSCLIRLFKTTVSCKLFTAIILSVFLVQPALTYAGVVIGGTRVVYLSNNPDKSISVFSKEEKIPYLIQAWVDPFNKEDKSKAPFTVIPPVSRLEPAQEKVLRIIHTKGVSLPDDRESVFWLNIKNIPPSASNKAANSLEIAVKTRIKLFWRPASIRLIPEDAAPKVKWHREGRNLIVENPNPIHISVMDVIVDGHDVPLNMIRPFETLTLPLPANSAGGQMIWRFINDYGAVSDPIKMTL

SEQ ID NO: 14801 - protein, 660 aa, Escherichia coli FVEC1302; identical to SEQ ID NO: 8092

SEQ ID NO: 14802 - protein, 412 aa, Escherichia coli FVEC1302
MKQWIAALLLMLIPGVQAAKPQKVTLMVDDVPVAQVLQALAEQEKLNLVVSPDVRGTVSLHLTDVPWKQALQTVVKSAGLITRQEGNILSVHSVAWQNDNIARQEAEQARAQANLPLENRNITLQYADAGELAKAGEKLLSAKGSMTVDKRTNRLLLRDNKAALSALEQWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 14803 - protein, 208 aa, Escherichia coli FVEC1302; identical to SEQ ID NO: 5717

SEQ ID NO: 14804 - protein, 614 aa, Escherichia coli FVEC1302
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVTVGHGNIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 14805 - protein, 446 aa, Escherichia coli FVEC1412; identical to SEQ ID NO: 6459

SEQ ID NO: 14806 - protein, 237 aa, Escherichia coli FVEC1412; identical to SEQ ID NO: 6384

SEQ ID NO: 14807 - protein, 478 aa, Escherichia coli FVEC1412; identical to SEQ ID NO: 14741

SEQ ID NO: 14808 - protein, 774 aa, Escherichia coli FVEC1412; identical to SEQ ID NO: 6382

SEQ ID NO: 14809 - protein, 368 aa, Escherichia coli FVEC1412; identical to SEQ ID NO: 6380

SEQ ID NO: 14810 - protein, 241 aa, Escherichia coli FVEC1412; identical to SEQ ID NO: 6143

SEQ ID NO: 14811 - protein, 878 aa, Escherichia coli FVEC1412; identical to SEQ ID NO: 6669

SEQ ID NO: 14812 - protein, 816 aa, Escherichia coli FVEC1412; identical to SEQ ID NO: 14730

SEQ ID NO: 14813 - protein, 227 aa, Escherichia coli FVEC1412; identical to SEQ ID NO: 8084

SEQ ID NO: 14814 - protein, 784 aa, Escherichia coli FVEC1412; identical to SEQ ID NO: 6283

SEQ ID NO: 14815 - protein, 170 aa, Escherichia coli FVEC1412; identical to SEQ ID NO: 5855

SEQ ID NO: 14816 - protein, 866 aa, Escherichia coli FVEC1412; identical to SEQ ID NO: 14734

SEQ ID NO: 14817 - protein, 243 aa, Escherichia coli FVEC1412; identical to SEQ ID NO: 14735

SEQ ID NO: 14818 - protein, 752 aa, Escherichia coli FVEC1412; identical to SEQ ID NO: 7439

SEQ ID NO: 14819 - protein, 266 aa, Escherichia coli FVEC1412; identical to SEQ ID NO: 8089

SEQ ID NO: 14820 - protein, 161 aa, Escherichia coli FVEC1412; identical to SEQ ID NO: 5769

SEQ ID NO: 14821 - protein, 221 aa, Escherichia coli FVEC1412; identical to SEQ ID NO: 6115

SEQ ID NO: 14822 - protein, 351 aa, Escherichia coli FVEC1412; identical to SEQ ID NO: 5767

SEQ ID NO: 14823 - protein, 230 aa, Escherichia coli FVEC1412; identical to SEQ ID NO: 14749

SEQ ID NO: 14824 - protein, 869 aa, Escherichia coli FVEC1412; identical to SEQ ID NO: 14750

SEQ ID NO: 14825 - protein, 360 aa, Escherichia coli FVEC1412; identical to SEQ ID NO: 5879

SEQ ID NO: 14826 - protein, 331 aa, Escherichia coli FVEC1412; identical to SEQ ID NO: 6551

SEQ ID NO: 14827 - protein, 760 aa, Escherichia coli FVEC1412; identical to SEQ ID NO: 8074

SEQ ID NO: 14828 - protein, 203 aa, Escherichia coli FVEC1412; identical to SEQ ID NO: 6414

SEQ ID NO: 14829 - protein, 517 aa, Escherichia coli FVEC1412; identical to SEQ ID NO: 6817

SEQ ID NO: 14830 - protein, 191 aa, Escherichia coli FVEC1412; identical to SEQ ID NO: 14762

SEQ ID NO: 14831 - protein, 232 aa, Escherichia coli FVEC1412; identical to SEQ ID NO: 5747

SEQ ID NO: 14832 - protein, 729 aa, Escherichia coli FVEC1412; identical to SEQ ID NO: 8069

SEQ ID NO: 14833 - protein, 213 aa, Escherichia coli FVEC1412; identical to SEQ ID NO: 5744

SEQ ID NO: 14834 - protein, 746 aa, Escherichia coli FVEC1412; identical to SEQ ID NO: 8052

SEQ ID NO: 14835 - protein, 193 aa, Escherichia coli FVEC1412; identical to SEQ ID NO: 6300

SEQ ID NO: 14836 - protein, 243 aa, Escherichia coli FVEC1412; identical to SEQ ID NO: 14754

SEQ ID NO: 14837 - protein, 816 aa, Escherichia coli FVEC1412; identical to SEQ ID NO: 14755

SEQ ID NO: 14838 - protein, 430 aa, Escherichia coli FVEC1412; identical to SEQ ID NO: 5758

SEQ ID NO: 14839 - protein, 119 aa, Escherichia coli FVEC1412; identical to SEQ ID NO: 5803

SEQ ID NO: 14840 - protein, 656 aa, Escherichia coli FVEC1412; identical to SEQ ID NO: 7573

SEQ ID NO: 14841 - protein, 753 aa, Escherichia coli FVEC1412; identical to SEQ ID NO: 5801

SEQ ID NO: 14842 - protein, 203 aa, Escherichia coli FVEC1412; identical to SEQ ID NO: 6347

SEQ ID NO: 14843 - protein, 565 aa, Escherichia coli FVEC1412; identical to SEQ ID NO: 14768

SEQ ID NO: 14844 - protein, 205 aa, Escherichia coli FVEC1412; identical to SEQ ID NO: 8627

SEQ ID NO: 14845 - protein, 551 aa, Escherichia coli FVEC1412; identical to SEQ ID NO: 5742

SEQ ID NO: 14846 - protein, 700 aa, Escherichia coli FVEC1412; identical to SEQ ID NO: 14775

SEQ ID NO: 14847 - protein, 366 aa, Escherichia coli FVEC1412; identical to SEQ ID NO: 7432

SEQ ID NO: 14848 - protein, 883 aa, Escherichia coli FVEC1412
MTAFRAAFKAYRMHQVLLLPRFARLTIALGLATAVFPVDAEYYFNPRFLSNDLAESVDLSAFTKGREAPPGTYRVDIYLNDEFITSRDITFIADDNNADLIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSIKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGKNKNGSIVAENGQVYLTGLPQSGKLQVSWGKDKNSNCIVEYKLPEVSPGTLLNQQTAICR

SEQ ID NO: 14849 - protein, 236 aa, Escherichia coli FVEC1412; identical to SEQ ID NO: 14777

SEQ ID NO: 14850 - protein, 118 aa, Escherichia coli FVEC1412 [sequence omitted]

SEQ ID NO: 14851 - protein, 402 aa, Escherichia coli FVEC1412; identical to SEQ ID NO: 14771

SEQ ID NO: 14852 - protein, 826 aa, Escherichia coli FVEC1412; identical to SEQ ID NO: 8096

SEQ ID NO: 14853 - protein, 224 aa, Escherichia coli FVEC1412; identical to SEQ ID NO: 14779

SEQ ID NO: 14854 - protein, 659 aa, Escherichia coli FVEC1412; identical to SEQ ID NO: 14780

SEQ ID NO: 14855 - protein, 828 aa, Escherichia coli FVEC1412; identical to SEQ ID NO: 6558

SEQ ID NO: 14856 - protein, 162 aa, Escherichia coli FVEC1412; identical to SEQ ID NO: 5896

SEQ ID NO: 14857 - protein, 367 aa, Escherichia coli FVEC1412; identical to SEQ ID NO: 14784

SEQ ID NO: 14858 - protein, 200 aa, Escherichia coli FVEC1412; identical to SEQ ID NO: 7474

SEQ ID NO: 14859 - protein, 274 aa, Escherichia coli FVEC1412; identical to SEQ ID NO: 8098

SEQ ID NO: 14860 - protein, 249 aa, Escherichia coli FVEC1412; identical to SEQ ID NO: 8118

SEQ ID NO: 14861 - protein, 879 aa, Escherichia coli FVEC1412; identical to SEQ ID NO: 14788

SEQ ID NO: 14862 - protein, 518 aa, Escherichia coli FVEC1412; identical to SEQ ID NO: 6358

SEQ ID NO: 14863 - protein, 679 aa, Escherichia coli FVEC1412
MSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPNTAQPVLPAQNQALPPEVRAFLNAGRTR

SEQ ID NO: 14864 - protein, 222 aa, Escherichia coli FVEC1412; identical to SEQ ID NO: 14796

SEQ ID NO: 14865 - protein, 678 aa, Escherichia coli FVEC1412; identical to SEQ ID NO: 14797

SEQ ID NO: 14866 - protein, 432 aa, Escherichia coli FVEC1412; identical to SEQ ID NO: 5727

SEQ ID NO: 14867 - protein, 567 aa, Escherichia coli FVEC1412; identical to SEQ ID NO: 6075

SEQ ID NO: 14868 - protein, 359 aa, Escherichia coli FVEC1412; identical to SEQ ID NO: 6332

SEQ ID NO: 14869 - protein, 244 aa, Escherichia coli FVEC1412; identical to SEQ ID NO: 6219

SEQ ID NO: 14870 - protein, 843 aa, Escherichia coli FVEC1412; identical to SEQ ID NO: 14792

SEQ ID NO: 14871 - protein, 696 aa, Escherichia coli FVEC1412; identical to SEQ ID NO: 14793

SEQ ID NO: 14872 - protein, 732 aa, Escherichia coli FVEC1412; identical to SEQ ID NO: 14794

SEQ ID NO: 14873 - protein, 412 aa, Escherichia coli FVEC1412; identical to SEQ ID NO: 14802

SEQ ID NO: 14874 - protein, 259 aa, Escherichia coli FVEC1412; identical to SEQ ID NO: 14798

SEQ ID NO: 14875 - protein, 250 aa, Escherichia coli FVEC1412; identical to SEQ ID NO: 6119

SEQ ID NO: 14876 - protein, 660 aa, Escherichia coli FVEC1412; identical to SEQ ID NO: 8092

SEQ ID NO: 14877 - protein, 243 aa, Escherichia coli FVEC1412; identical to SEQ ID NO: 14800

SEQ ID NO: 14878 - protein, 208 aa, Escherichia coli FVEC1412; identical to SEQ ID NO: 5717

SEQ ID NO: 14879 - protein, 614 aa, Escherichia coli FVEC1412; identical to SEQ ID NO: 14804

SEQ ID NO: 14880 - protein, 170 aa, Escherichia coli G58-1
MGGKCRWCKGWSFYRDATSVCDEGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 14881 - protein, 856 aa, Escherichia coli G58-1; identical to SEQ ID NO: 9540

SEQ ID NO: 14882 - protein, 810 aa, Escherichia coli G58-1
MGRCYYFLYSFPGYAEETFDTHFMIGGMRGEKVSEYRFDNKQPLPGNYELDFYVNHQWRGKKDITIPESPAKPCLPKVLLTTLGVKTDNLNTEDNCILLDEAVHGGQYQWDISEHRLNLTIPQAYINELERGYVPPESWDRGIDAFYTSYNLSQYRSYDSNNNSNTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYIIYQKEVPPGPFTIADLQLSGSGADLDVSIKEADGSVRSFLVPYSSVPNMLQPGVSNFDFIAGRSKIYGVKNQEDFLEANYIYGLNNLLTLYGSTILSDNYNAITLGNGWNTPLGAISFDATRSSSKLNNDITHEGTSYQVAYNKYLVQTATRFSVAAWRYASQDYRTFSDHLYENDKHNHQSEYDDFYDIGRKNSLSANIMQPLSNNLGNVSLSALWRNYWGRSGNAKDYQFSYSNSWQRISYTFSASQSYDENDKEEERFNLFISIPFYWGDDITKTRHQINLSNSTSFSKDGYSSNNTGVTGIAGEHDQLNYGIYVNQQQQNNDTSLGTNLSWRTPIAIIDGSYSHSKNTWQSGGSISSGLVVWPGGINITNQLSDTFAILDAPGLEGAHINGQKYNRTNSKGQVVYDLMIPHRENHLVLDIANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 14883 - protein, 187 aa, Escherichia coli G58-1
MNQSKNASLIQAWIDDGNTTIAPEKIQVLFILTPPVSRVAGGSGQQLKIRKMPNNLPHNKESLFYLNVLDIPPNNPQNAGKNKIKLAFQNRIKLLWRPSGIAPVDKKSLSQLNIKKKNNAISINNETANWITVTTIKAQNVKVNNESILLPPFSNNDITLKNNHASEYELTVVDDYGNNIHSKIAAR

SEQ ID NO: 14884 - protein, 784 aa, Escherichia coli G58-1; identical to SEQ ID NO: 14497

SEQ ID NO: 14885 - protein, 170 aa, Escherichia coli G58-1 [sequence omitted]

SEQ ID NO: 14886 - protein, 865 aa, Escherichia coli G58-1
MTIEYTKNYHHLTRIATFCALLYCNTAFSAELVEYDHTFLMGQNASNIDLSRYSEGNPAIPGVYDVSVYVNDQPIINQSITFVAIEGKKNAQACITLKNLLQFHINSPDINNEKAVLLARDETLGNCLNLTEIIPQASVRYDVNDQRLDIDVPQAWVMKNYQNYVDPSLWENGINAAMLSYNLNGYHSETPGRKNESIYAAFNGGMNLGAWRLRASGNYNWMTDSGSNYDFKNRYVQRDIASLRSQLILGESYTTGETFDSVSIRGIRLYSDSRMLPPTLASFAPIIHGVANTNAKVTITQGGYKIYETTVPPGAFVIDDLSPSGYGSDLIVTIEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKFMRNYSRMKNQVTVSINQPLKFEKKDYGSFYLSGSWSDYWASGQNRSNYSIGYSNSTSWGSYSVSAQRSWNEDGDTDDSVYLSFTIPIEKLLGTEQRTSGFQSIDTQISSDFKGNNQLNVSSSGYSDNARVSYSVNTGYTMNKASKDLSYVGGYASYESPWGTLAGSISANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEQSKPVSCLAHYQQSPEAEKIAQSIILNGIRCQIQ

SEQ ID NO: 14887 - protein, 230 aa, Escherichia coli G58-1; identical to SEQ ID NO: 8021

SEQ ID NO: 14888 - protein, 747 aa, Escherichia coli G58-1; identical to SEQ ID NO: 6343

SEQ ID NO: 14889 - protein, 266 aa, Escherichia coli G58-1; identical to SEQ ID NO: 5772

SEQ ID NO: 14890 - protein, 161 aa, Escherichia coli G58-1; identical to SEQ ID NO: 5769

SEQ ID NO: 14891 - protein, 351 aa, Escherichia coli G58-1; identical to SEQ ID NO: 14443

SEQ ID NO: 14892 - protein, 229 aa, Escherichia coli G58-1
MTKIKLLMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 14893 - protein, 630 aa, Escherichia coli G58-1
MRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADASRHEGDSIRFLYAKSMNTFGTNFQLMGYRYSTQGFYTLDDVAYRRMEGYEYDYDGEHRDEPIIVNYHNLRFSRKDRLQLNVSQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGGGYNYDRDQHDVNWQLSGGVVGHENGITLSQPLGDTNVLIKAPGAGGVRIENQTGILTDWRGYAVMLYATVYRYNRIALDTNTMGNSIDVEKILAALCRRKARWFVPILIPA

SEQ ID NO: 14894 - protein, 746 aa, Escherichia coli G58-1
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMLTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 14895 - protein, 193 aa, Escherichia coli G58-1; identical to SEQ ID NO: 6300

SEQ ID NO: 14896 - protein, 242 aa, Escherichia coli G58-1; identical to SEQ ID NO: 6420

SEQ ID NO: 14897 - protein, 818 aa, Escherichia coli G58-1; identical to SEQ ID NO: 6419

SEQ ID NO: 14898 - protein, 430 aa, Escherichia coli G58-1; identical to SEQ ID NO: 5758

SEQ ID NO: 14899 - protein, 331 aa, Escherichia coli G58-1; identical to SEQ ID NO: 6551

SEQ ID NO: 14900 - protein, 760 aa, Escherichia coli G58-1; identical to SEQ ID NO: 6415

SEQ ID NO: 14901 - protein, 203 aa, Escherichia coli G58-1; identical to SEQ ID NO: 6414

SEQ ID NO: 14902 - protein, 361 aa, Escherichia coli G58-1; identical to SEQ ID NO: 7868

SEQ ID NO: 14903 - protein, 233 aa, Escherichia coli G58-1; identical to SEQ ID NO: 6411

SEQ ID NO: 14904 - protein, 591 aa, Escherichia coli G58-1; identical to SEQ ID NO: 7988

SEQ ID NO: 14905 - protein, 128 aa, Escherichia coli G58-1; identical to SEQ ID NO: 7750

SEQ ID NO: 14906 - protein, 517 aa, Escherichia coli G58-1; identical to SEQ ID NO: 6406

SEQ ID NO: 14907 - protein, 191 aa, Escherichia coli G58-1; identical to SEQ ID NO: 5748

SEQ ID NO: 14908 - protein, 232 aa, Escherichia coli G58-1; identical to SEQ ID NO: 5747

SEQ ID NO: 14909 - protein, 729 aa, Escherichia coli G58-1; identical to SEQ ID NO: 6402

SEQ ID NO: 14910 - protein, 213 aa, Escherichia coli G58-1
MTKMSRYALITALAMFLAGCVGQREPAPVEEVKPAPEQPAEPQQPVPTVPSVPTIPQQPGPIEHEDQTAPPAPHIRYYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 14911 - protein, 203 aa, Escherichia coli G58-1; identical to SEQ ID NO: 6396

SEQ ID NO: 14912 - protein, 565 aa, Escherichia coli G58-1; identical to SEQ ID NO: 6395

SEQ ID NO: 14913 - protein, 207 aa, Escherichia coli G58-1; identical to SEQ ID NO: 5743

SEQ ID NO: 14914 - protein, 541 aa, Escherichia coli G58-1; identical to SEQ ID NO: 6754

SEQ ID NO: 14915 - protein, 700 aa, Escherichia coli G58-1; identical to SEQ ID NO: 6388

SEQ ID NO: 14916 - protein, 102 aa, Escherichia coli G58-1; identical to SEQ ID NO: 6385

SEQ ID NO: 14917 - protein, 118 aa, Escherichia coli G58-1 [sequence omitted]

SEQ ID NO: 14918 - protein, 518 aa, Escherichia coli G58-1; identical to SEQ ID NO: 6358

SEQ ID NO: 14919 - protein, 641 aa, Escherichia coli G58-1
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEYRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 14920 - protein, 828 aa, Escherichia coli G58-1; identical to SEQ ID NO: 6366

SEQ ID NO: 14921 - protein, 162 aa, Escherichia coli G58-1; identical to SEQ ID NO: 6365

SEQ ID NO: 14922 - protein, 367 aa, Escherichia coli G58-1; identical to SEQ ID NO: 5789

SEQ ID NO: 14923 - protein, 200 aa, Escherichia coli G58-1; identical to SEQ ID NO: 6363

SEQ ID NO: 14924 - protein, 274 aa, Escherichia coli G58-1; identical to SEQ ID NO: 6362

SEQ ID NO: 14925 - protein, 250 aa, Escherichia coli G58-1; identical to SEQ ID NO: 6361

SEQ ID NO: 14926 - protein, 862 aa, Escherichia coli G58-1
MSGSYSSVWAEDDIQFDSRFLELKGDTKIDLKRFSSQGYVEPGKYNLQVQLNKQPLAEEYDIYWYAGEDDVSKSYACLTPELVAQFGLKEDVAKNLQWSHDGKCLKPGQLEGVEIKADLSQSALVISLPQAYLEYTWPDWDPPSRWDDGISGIIADYSITAQTRHEENGGDDSNEISGNGTVGVNLGPWRMRADWQTNYQHTRSNDDDDEFGGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGGFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNIGTSDKHTSVDGYYSHDGSLAQVDLSANYHEGQYTSAGLSLQGGATLTTHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGSVYLAGVKPGEHMSVFWSGVAHCDINLPDPLPADLFNGLLLPCQHKGNVAPVVPDDIKPVIQEQTQQVTPTDPPVSVSANQ

SEQ ID NO: 14927 - protein, 432 aa, Escherichia coli G58-1; identical to SEQ ID NO: 5727

SEQ ID NO: 14928 - protein, 249 aa, Escherichia coli G58-1; identical to SEQ ID NO: 6519

SEQ ID NO: 14929 - protein, 562 aa, Escherichia coli G58-1
MLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 14930 - protein, 249 aa, Escherichia coli G58-1; identical to SEQ ID NO: 6407

SEQ ID NO: 14931 - protein, 231 aa, Escherichia coli G58-1; identical to SEQ ID NO: 6400

SEQ ID NO: 14932 - protein, 721 aa, Escherichia coli G58-1; identical to SEQ ID NO: 12826

SEQ ID NO: 14933 - protein, 678 aa, Escherichia coli G58-1; identical to SEQ ID NO: 6398

SEQ ID NO: 14934 - protein, 738 aa, Escherichia coli G58-1; identical to SEQ ID NO: 12828

SEQ ID NO: 14935 - protein, 650 aa, Escherichia coli G58-1; identical to SEQ ID NO: 6393

SEQ ID NO: 14936 - protein, 888 aa, Escherichia coli G58-1
MIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKSNDASNPWRYVRAATATEISETSNPQSCTSAPQPSPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGGAVTPVDPTPETPVTPTPDNSEPSTPADSVNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLKVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 14937 - protein, 386 aa, Escherichia coli G58-1; identical to SEQ ID NO: 7993

SEQ ID NO: 14938 - protein, 208 aa, Escherichia coli G58-1; identical to SEQ ID NO: 5717

SEQ ID NO: 14939 - protein, 614 aa, Escherichia coli G58-1; identical to SEQ ID NO: 6387

SEQ ID NO: 14940 - protein, 446 aa, Escherichia coli G58-1 [sequence omitted]

SEQ ID NO: 14941 - protein, 774 aa, Escherichia coli G58-1; identical to SEQ ID NO: 14491

SEQ ID NO: 14942 - protein, 122 aa, Escherichia coli H120; identical to SEQ ID NO: 5737

SEQ ID NO: 14943 - protein, 111 aa, Escherichia coli H120; identical to SEQ ID NO: 7885

SEQ ID NO: 14944 - protein, 236 aa, Escherichia coli H120; identical to SEQ ID NO: 6472

SEQ ID NO: 14945 - protein, 865 aa, Escherichia coli H120; identical to SEQ ID NO: 14119

SEQ ID NO: 14946 - protein, 700 aa, Escherichia coli H120; identical to SEQ ID NO: 7945

SEQ ID NO: 14947 - protein, 551 aa, Escherichia coli H120; identical to SEQ ID NO: 5742

SEQ ID NO: 14948 - protein, 207 aa, Escherichia coli H120; identical to SEQ ID NO: 5743

SEQ ID NO: 14949 - protein, 565 aa, Escherichia coli H120; identical to SEQ ID NO: 6492

SEQ ID NO: 14950 - protein, 203 aa, Escherichia coli H120; identical to SEQ ID NO: 6396

SEQ ID NO: 14951 - protein, 213 aa, Escherichia coli H120; identical to SEQ ID NO: 5744

SEQ ID NO: 14952 - protein, 729 aa, Escherichia coli H120
MLSTQFNRDNQYQASTKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGIYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 14953 - protein, 232 aa, Escherichia coli H120; identical to SEQ ID NO: 5747

SEQ ID NO: 14954 - protein, 191 aa, Escherichia coli H120
MKKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPLATFTSTSVKKDGDELDITGDLTLNGVTKPVTLEAKLIGQGDDPWGGKRAGFEAEGKIKLKDFNIKTDLGPASQEVDLIISVEGVQQK

SEQ ID NO: 14955 - protein, 517 aa, Escherichia coli H120; identical to SEQ ID NO: 6817

SEQ ID NO: 14956 - protein, 161 aa, Escherichia coli H120
MPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQLSVNGKALSNAGVVPPKSQRQTSWCQAIAPCHVAWRAINDYGGLSAKKEQNLP

SEQ ID NO: 14957 - protein, 760 aa, Escherichia coli H120
MGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 14958 - protein, 233 aa, Escherichia coli H120; identical to SEQ ID NO: 7394

SEQ ID NO: 14959 - protein, 362 aa, Escherichia coli H120; identical to SEQ ID NO: 5809

SEQ ID NO: 14960 - protein, 203 aa, Escherichia coli H120; identical to SEQ ID NO: 6414

SEQ ID NO: 14961 - protein, 760 aa, Escherichia coli H120; identical to SEQ ID NO: 6322

SEQ ID NO: 14962 - protein, 431 aa, Escherichia coli H120; identical to SEQ ID NO: 6791

SEQ ID NO: 14963 - protein, 816 aa, Escherichia coli H120; identical to SEQ ID NO: 6462

SEQ ID NO: 14964 - protein, 243 aa, Escherichia coli H120; identical to SEQ ID NO: 6463

SEQ ID NO: 14965 - protein, 678 aa, Escherichia coli H120; identical to SEQ ID NO: 7364

SEQ ID NO: 14966 - protein, 838 aa, Escherichia coli H120; identical to SEQ ID NO: 8366

SEQ ID NO: 14967 - protein, 231 aa, Escherichia coli H120; identical to SEQ ID NO: 6351

SEQ ID NO: 14968 - protein, 249 aa, Escherichia coli H120; identical to SEQ ID NO: 6450

SEQ ID NO: 14969 - protein, 834 aa, Escherichia coli H120; identical to SEQ ID NO: 8715

SEQ ID NO: 14970 - protein, 615 aa, Escherichia coli H120
MFWRDITLSVWRKKTTGLKTKKRLLPLVLAAALCSSPVWAEEATFTANFKDTDLKSFIETVGANLNKTIIMGQGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKENVT

SEQ ID NO: 14971 - protein, 360 aa, Escherichia coli H120; identical to SEQ ID NO: 6702

SEQ ID NO: 14972 - protein, 432 aa, Escherichia coli H120; identical to SEQ ID NO: 5727

SEQ ID NO: 14973 - protein, 446 aa, Escherichia coli H120; identical to SEQ ID NO: 6459

SEQ ID NO: 14974 - protein, 237 aa, Escherichia coli H120; identical to SEQ ID NO: 6458

SEQ ID NO: 14975 - protein, 478 aa, Escherichia coli H120; identical to SEQ ID NO: 5711

SEQ ID NO: 14976 - protein, 774 aa, Escherichia coli H120; identical to SEQ ID NO: 7727

SEQ ID NO: 14977 - protein, 368 aa, Escherichia coli H120
MNKTITALAIMMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLDPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKVVTDSVLISVKDNKVTVQI

SEQ ID NO: 14978 - protein, 241 aa, Escherichia coli H120; identical to SEQ ID NO: 6138

SEQ ID NO: 14979 - protein, 878 aa, Escherichia coli H120
MSYLNLRLYQRNTQCLHIRKHRLAGFFVRLVVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 14980 - protein, 784 aa, Escherichia coli H120; identical to SEQ ID NO: 6283

SEQ ID NO: 14981 - protein, 866 aa, Escherichia coli H120
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTIMQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGSLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 14982 - protein, 230 aa, Escherichia coli H120; identical to SEQ ID NO: 7855

SEQ ID NO: 14983 - protein, 747 aa, Escherichia coli H120; identical to SEQ ID NO: 6343

SEQ ID NO: 14984 - protein, 266 aa, Escherichia coli H120; identical to SEQ ID NO: 5772

SEQ ID NO: 14985 - protein, 161 aa, Escherichia coli H120; identical to SEQ ID NO: 5769

SEQ ID NO: 14986 - protein, 351 aa, Escherichia coli H120; identical to SEQ ID NO: 5767

SEQ ID NO: 14987 - protein, 230 aa, Escherichia coli H120; identical to SEQ ID NO: 6294

SEQ ID NO: 14988 - protein, 780 aa, Escherichia coli H120
MKIPTTTDIPQRYTWCLAGICYSSLAILPSFLSYAESYFNPAFLLENGTSVADLSRFERGNHQPARVYRVDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKILAALCRRKARWFVPILIPA

SEQ ID NO: 14989 - protein, 823 aa, Escherichia coli H120
MFTVQFFIDCRNILIILLITICICNSVMARRGKRGHLLTNCTACLSGSKVFAVAGCVVLRTTMPDSCNSWQKCRNKTMNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 14990 - protein, 193 aa, Escherichia coli H120; identical to SEQ ID NO: 6300

SEQ ID NO: 14991 - protein, 374 aa, Escherichia coli H120; identical to SEQ ID NO: 5788

SEQ ID NO: 14992 - protein, 823 aa, Escherichia coli H120
MTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKHSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 14993 - protein, 154 aa, Escherichia coli H120; identical to SEQ ID NO: 9702

SEQ ID NO: 14994 - protein, 663 aa, Escherichia coli H120; identical to SEQ ID NO: 6307

SEQ ID NO: 14995 - protein, 828 aa, Escherichia coli H120; identical to SEQ ID NO: 6558

SEQ ID NO: 14996 - protein, 162 aa, Escherichia coli H120; identical to SEQ ID NO: 5896

SEQ ID NO: 14997 - protein, 200 aa, Escherichia coli H120
MLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQSKALDKNIVIFTHNHCLTYIAKNKRDATFKPDYLDGLVMHVEKGKVYLDGEFVNH

SEQ ID NO: 14998 - protein, 274 aa, Escherichia coli H120; identical to SEQ ID NO: 8357

SEQ ID NO: 14999 - protein, 250 aa, Escherichia coli H120; identical to SEQ ID NO: 7896

SEQ ID NO: 15000 - protein, 881 aa, Escherichia coli H120
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVANNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLSDGSHPPFGAEVKNDNEQTVGLVDDDGNVYLAGVKPGEHMSVFWSGVAHCDINLPDPLPADLFNGLLLPCQHKGNVAPITSPAVKPAIQEQTQRVTPTEPPTSISVNQ

SEQ ID NO: 15001 - protein, 518 aa, Escherichia coli H120; identical to SEQ ID NO: 7565

SEQ ID NO: 15002 - protein, 412 aa, Escherichia coli H120; identical to SEQ ID NO: 6284

SEQ ID NO: 15003 - protein, 198 aa, Escherichia coli H120; identical to SEQ ID NO: 8853

SEQ ID NO: 15004 - protein, 1024 aa, Escherichia coli H120; identical to SEQ ID NO: 5698

SEQ ID NO: 15005 - protein, 121 aa, Escherichia coli H120; identical to SEQ ID NO: 5676

SEQ ID NO: 15006 - protein, 208 aa, Escherichia coli H120; identical to SEQ ID NO: 5717

SEQ ID NO: 15007 - protein, 614 aa, Escherichia coli H120; identical to SEQ ID NO: 7971

SEQ ID NO: 15008 - protein, 203 aa, Escherichia coli H252; identical to SEQ ID NO: 6414

SEQ ID NO: 15009 - protein, 760 aa, Escherichia coli H252; identical to SEQ ID NO: 7535

SEQ ID NO: 15010 - protein, 332 aa, Escherichia coli H252; identical to SEQ ID NO: 5870

SEQ ID NO: 15011 - protein, 380 aa, Escherichia coli H252; identical to SEQ ID NO: 7505

SEQ ID NO: 15012 - protein, 213 aa, Escherichia coli H252; identical to SEQ ID NO: 5744

SEQ ID NO: 15013 - protein, 729 aa, Escherichia coli H252; identical to SEQ ID NO: 6821

SEQ ID NO: 15014 - protein, 232 aa, Escherichia coli H252; identical to SEQ ID NO: 5747

SEQ ID NO: 15015 - protein, 191 aa, Escherichia coli H252; identical to SEQ ID NO: 5748

SEQ ID NO: 15016 - protein, 517 aa, Escherichia coli H252; identical to SEQ ID NO: 6817

SEQ ID NO: 15017 - protein, 362 aa, Escherichia coli H252; identical to SEQ ID NO: 5874

SEQ ID NO: 15018 - protein, 430 aa, Escherichia coli H252; identical to SEQ ID NO: 5758

SEQ ID NO: 15019 - protein, 351 aa, Escherichia coli H252; identical to SEQ ID NO: 7560

SEQ ID NO: 15020 - protein, 193 aa, Escherichia coli H252; identical to SEQ ID NO: 6300

SEQ ID NO: 15021 - protein, 668 aa, Escherichia coli H252
MLMTTMPDSCNSWQKCRNKTMNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGYETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFT

SEQ ID NO: 15022 - protein, 60 aa, Escherichia coli H252
MTKNVSLTGGVDNLFDKRLWRAGNAQTTGDLAGANYIAGAGAYTYNEPGRTWYMSINTHF

SEQ ID NO: 15023 - protein, 700 aa, Escherichia coli H252; identical to SEQ ID NO: 7559

SEQ ID NO: 15024 - protein, 551 aa, Escherichia coli H252; identical to SEQ ID NO: 5885

SEQ ID NO: 15025 - protein, 883 aa, Escherichia coli H252
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFDGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGNLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTQGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVDYKLPVVSPGTLLNQQTAICR

SEQ ID NO: 15026 - protein, 236 aa, Escherichia coli H252; identical to SEQ ID NO: 7624

SEQ ID NO: 15027 - protein, 111 aa, Escherichia coli H252; identical to SEQ ID NO: 5889

SEQ ID NO: 15028 - protein, 122 aa, Escherichia coli H252; identical to SEQ ID NO: 5737

SEQ ID NO: 15029 - protein, 360 aa, Escherichia coli H252; identical to SEQ ID NO: 5891

SEQ ID NO: 15030 - protein, 673 aa, Escherichia coli H252; identical to SEQ ID NO: 8416

SEQ ID NO: 15031 - protein, 826 aa, Escherichia coli H252; identical to SEQ ID NO: 7523

SEQ ID NO: 15032 - protein, 224 aa, Escherichia coli H252; identical to SEQ ID NO: 5893

SEQ ID NO: 15033 - protein, 641 aa, Escherichia coli H252; identical to SEQ ID NO: 8755

SEQ ID NO: 15034 - protein, 828 aa, Escherichia coli H252; identical to SEQ ID NO: 7510

SEQ ID NO: 15035 - protein, 162 aa, Escherichia coli H252; identical to SEQ ID NO: 8101

SEQ ID NO: 15036 - protein, 363 aa, Escherichia coli H252; identical to SEQ ID NO: 7508

SEQ ID NO: 15037 - protein, 200 aa, Escherichia coli H252; identical to SEQ ID NO: 5898

SEQ ID NO: 15038 - protein, 274 aa, Escherichia coli H252; identical to SEQ ID NO: 5899

SEQ ID NO: 15039 - protein, 250 aa, Escherichia coli H252; identical to SEQ ID NO: 7503

SEQ ID NO: 15040 - protein, 884 aa, Escherichia coli H252; identical to SEQ ID NO: 7607

SEQ ID NO: 15041 - protein, 686 aa, Escherichia coli H252; identical to SEQ ID NO: 7542

SEQ ID NO: 15042 - protein, 682 aa, Escherichia coli H252; identical to SEQ ID NO: 6110

SEQ ID NO: 15043 - protein, 836 aa, Escherichia coli H252
MKDRIPFAVNNITCVILLSLFCNAASAVEFNTDVLDAADKKNIDFTRFSEAGYVLPGQYLLDVIVNGQSISPASLQISFVEPALSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLAASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 15044 - protein, 244 aa, Escherichia coli H252; identical to SEQ ID NO: 6111

SEQ ID NO: 15045 - protein, 360 aa, Escherichia coli H252; identical to SEQ ID NO: 6702

SEQ ID NO: 15046 - protein, 678 aa, Escherichia coli H252; identical to SEQ ID NO: 7525

SEQ ID NO: 15047 - protein, 246 aa, Escherichia coli H252
MKSPLITTGMICLLGICNFAQATVSPDRTRIIFNASNKSATVRLTNQSKIDPYLAQSWIEDASGKKTRDYISTLPPMERIEPDEQIQIRLMALASLNDLPQDRETLFYYNVREIPPRAKEQNVMQIAMQSRLKLFWRPKAIELKEGEMIPLQKVTITRTAAGLTLNNPTPYHITVGYIGTNGKTLMPGADSIMVVPFTSATQHLSSLPSTFQLGFVADYGGLEMFKVECNSIQSLCQTSPAKKGKI

SEQ ID NO: 15048 - protein, 840 aa, Escherichia coli H252; identical to SEQ ID NO: 7530

SEQ ID NO: 15049 - protein, 713 aa, Escherichia coli H252; identical to SEQ ID NO: 6056

SEQ ID NO: 15050 - protein, 432 aa, Escherichia coli H252; identical to SEQ ID NO: 5727

SEQ ID NO: 15051 - protein, 161 aa, Escherichia coli H252; identical to SEQ ID NO: 5769

SEQ ID NO: 15052 - protein, 266 aa, Escherichia coli H252; identical to SEQ ID NO: 7500

SEQ ID NO: 15053 - protein, 747 aa, Escherichia coli H252; identical to SEQ ID NO: 7499

SEQ ID NO: 15054 - protein, 246 aa, Escherichia coli H252
MFFNTKHTAALCLASCMAFSSSAIADIVISGTRVVYKSEQKSVNVRLENKGNNPLLVQSWLDTGDDNAEPGSITVPFTATPPVSRIDAKRGQTIKLMYTASSALPKDRESVFWFNVLEVPPKPDAAKAANQSLLQLAFRTRIKLFYRPEGLSGISSDAPLALKWSWATSEGKAALRVDNPTPYYVSFSSGDLEANGKRYPLDMTMIAPFSNDVIKVNGMSGRTSSAKVHFFAINDFGGSIEGNTNL

SEQ ID NO: 15055 - protein, 862 aa, Escherichia coli H252; identical to SEQ ID NO: 7497

SEQ ID NO: 15056 - protein, 784 aa, Escherichia coli H252; identical to SEQ ID NO: 6829

SEQ ID NO: 15057 - protein, 774 aa, Escherichia coli H252; identical to SEQ ID NO: 6673

SEQ ID NO: 15058 - protein, 878 aa, Escherichia coli H252; identical to SEQ ID NO: 6669

SEQ ID NO: 15059 - protein, 241 aa, Escherichia coli H252; identical to SEQ ID NO: 6143

SEQ ID NO: 15060 - protein, 368 aa, Escherichia coli H252; identical to SEQ ID NO: 6380

SEQ ID NO: 15061 - protein, 478 aa, Escherichia coli H252; identical to SEQ ID NO: 6796

SEQ ID NO: 15062 - protein, 237 aa, Escherichia coli H252; identical to SEQ ID NO: 7546

SEQ ID NO: 15063 - protein, 446 aa, Escherichia coli H252; identical to SEQ ID NO: 5873

SEQ ID NO: 15064 - protein, 654 aa, Escherichia coli H252; identical to SEQ ID NO: 6816

SEQ ID NO: 15065 - protein, 645 aa, Escherichia coli H252
MGAANCPGDAKENDASNPWRYVRAATATEITQYGNPASCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSANSIVDYNDAHYKTSVDQDAWGFVPGGDNPWKKYEPAKAWSASTVYVKGDRVVVDGQAYEALFWTQSDNPALIANQNATGSNSRPWKPLGKTHSYSNEELNNAPQFNPETLYASDTLIRFNGENYISQSKVQKVSPSDSNPWRVFVDWTGTKERVGTPKKAWPKHVYAPYVDFTLNTIPDLAALAKSHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 15066 - protein, 412 aa, Escherichia coli H252; identical to SEQ ID NO: 7596

SEQ ID NO: 15067 - protein, 259 aa, Escherichia coli H252; identical to SEQ ID NO: 8776

SEQ ID NO: 15068 - protein, 250 aa, Escherichia coli H252; identical to SEQ ID NO: 5862

SEQ ID NO: 15069 - protein, 660 aa, Escherichia coli H252; identical to SEQ ID NO: 6109

SEQ ID NO: 15070 - protein, 207 aa, Escherichia coli H252; identical to SEQ ID NO: 7443

SEQ ID NO: 15071 - protein, 565 aa, Escherichia coli H252; identical to SEQ ID NO: 7493

SEQ ID NO: 15072 - protein, 656 aa, Escherichia coli H252; identical to SEQ ID NO: 7494

SEQ ID NO: 15073 - protein, 203 aa, Escherichia coli H252; identical to SEQ ID NO: 7450

SEQ ID NO: 15074 - protein, 614 aa, Escherichia coli H252; identical to SEQ ID NO: 7540

SEQ ID NO: 15075 - protein, 208 aa, Escherichia coli H252; identical to SEQ ID NO: 5869

SEQ ID NO: 15076 - protein, 518 aa, Escherichia coli H252; identical to SEQ ID NO: 7565

SEQ ID NO: 15077 - protein, 121 aa, Escherichia coli H252; identical to SEQ ID NO: 6175

SEQ ID NO: 15078 - protein, 725 aa, Escherichia coli H252
MRINKILWSLTVLLVGLNSQISVAKSSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSDEGATRRANFSLSGPLAGNALTTRLYGNLNKTDADSWDINSPVGTKNAAGHEGVRNKDINGVVSWKLNPQQILDFEAGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDSDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 15079 - protein, 733 aa, Escherichia coli H252; identical to SEQ ID NO: 5674

SEQ ID NO: 15080 - protein, 430 aa, Escherichia coli H263; identical to SEQ ID NO: 5758

SEQ ID NO: 15081 - protein, 746 aa, Escherichia coli H263; identical to SEQ ID NO: 6783

SEQ ID NO: 15082 - protein, 193 aa, Escherichia coli H263; identical to SEQ ID NO: 6300

SEQ ID NO: 15083 - protein, 332 aa, Escherichia coli H263; identical to SEQ ID NO: 5870

SEQ ID NO: 15084 - protein, 760 aa, Escherichia coli H263; identical to SEQ ID NO: 7535

SEQ ID NO: 15085 - protein, 203 aa, Escherichia coli H263; identical to SEQ ID NO: 6414

SEQ ID NO: 15086 - protein, 362 aa, Escherichia coli H263; identical to SEQ ID NO: 5874

SEQ ID NO: 15087 - protein, 517 aa, Escherichia coli H263; identical to SEQ ID NO: 6817

SEQ ID NO: 15088 - protein, 191 aa, Escherichia coli H263; identical to SEQ ID NO: 5748

SEQ ID NO: 15089 - protein, 232 aa, Escherichia coli H263; identical to SEQ ID NO: 5747

SEQ ID NO: 15090 - protein, 729 aa, Escherichia coli H263; identical to SEQ ID NO: 6821

SEQ ID NO: 15091 - protein, 213 aa, Escherichia coli H263; identical to SEQ ID NO: 5744

SEQ ID NO: 15092 - protein, 380 aa, Escherichia coli H263; identical to SEQ ID NO: 7505

SEQ ID NO: 15093 - protein, 678 aa, Escherichia coli H263; identical to SEQ ID NO: 7525

SEQ ID NO: 15094 - protein, 246 aa, Escherichia coli H263
MKSPLITTGMICLLGICNFAQATVSPDRTRIIFNASNKSATVRLTNQSKIDPYLAQSWIEDASGKKTRDYISTLPPMERIEPDEQIQIRLMALASLNDLPQDRETLFYYNVREIPPRAKEQNVMQIAMQSRLKLFWRPKAIELKEGEMIPLQKVTITRTAAGLTLNNPTPYHITVGYIGTNGKTLMPGADSIMVVPFTSATQHLSSLPSTFQLGFVADYGGLEMFKVECNSIQSLCQSSPAKKGKI

SEQ ID NO: 15095 - protein, 840 aa, Escherichia coli H263; identical to SEQ ID NO: 7530

SEQ ID NO: 15096 - protein, 711 aa, Escherichia coli H263; identical to SEQ ID NO: 8769

SEQ ID NO: 15097 - protein, 615 aa, Escherichia coli H263
MFWRDMTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPVIGNLFKSTADKKENVT

SEQ ID NO: 15098 - protein, 682 aa, Escherichia coli H263; identical to SEQ ID NO: 6110

SEQ ID NO: 15099 - protein, 836 aa, Escherichia coli H263; identical to SEQ ID NO: 15043

SEQ ID NO: 15100 - protein, 244 aa, Escherichia coli H263
  MOD_RES (243)..(243): Any amino acid
MWKLSMIRKKILMAAIPLFVISGADAAVSLDRTRAVFDGSEKSMTLDISNDNKQLPYLAQAWIENENQEKIITGPVIATPPVQRLEPGAKSMVRLSTTPDISKLPQDRESLFYFNLREIPPRSEKANVLQIALQTKIKLFYRPAAIKTRPNEVWQDQLILNKVSGGYRIENPTPYYVTVIGLGGSEKQAEEGEFETVMLSPRSEQTVKSANYNTPYLSYINDYGGRPVLSFICNGSRCSVKKXK

SEQ ID NO: 15101 - protein, 153 aa, Escherichia coli H263
MYTGEALPNDRESIFWLNVLDISAKPKFENKNNLNVNSNYLQLPIHSRIKLFYCPEKLTRSLSEAYNSVIWHIEKQGAKAFLCADNQSPYFITYNHITLIQSNYSQSINPVDMVAPYSSIRLPIHGNMSGYGKVKWTVVNDYGGHELSESALK

SEQ ID NO: 15102 - protein, 693 aa, Escherichia coli H263
MKKSIFNYTTFFISMSYSLFANASPAIKSTENRNNEVLEVYSTPLHTPQEKMAIPVSVLTQEDLRANRSASIAETLTSLPGFHASFFGGGSVHPVIRGMSGNRVKVLHSGSDLMDVSSIGADHTITSEPFLSQRIEVLKGPSTLLYGGGTIGGAINVIDSKIPMSVPEKGYEGELHYQYDSVSKGNTGSVGLTLGENNLALRLEGTKRYQSDYKQPEPLHQGETSRLAGSYQDNQSANIGVSWLFDDGYIGIGYGEQHRRYGLPGHTHFHDHEDDHHHHAPIRPPLIGHHHHNHNHEYPDEQHQHGIPYIVMDSKRWDLRGEKNNPFTGIESIRFSAVRTDYHHDEKEGNEVSTSFKNKGDELRLTFTHQPIWGWHGVIGGQFNQRDFSAQGEEAYVPSTKTKNHSLFLLEEYQLGDFRYELGFRQEWQSLLNRETQKNNKQSASSISAGLAWNFTQDYFLNLSLSHTKRLPVAEELYANGVHAASRTIEKGDPNLTAEAANNIDIGITKVTGDIQFNMSAYYNRINNYIYGQFTGTELNNGYRSLQYVQNDAQFKGIEGNIDYYYNQDSLIGISGDYVRANLLHNKGNIPRIPAYRLSTYIKHSFTENVIGQIRIDHFGKQNKTADYETSTEAYNTVSLGSEYIGYLDNTDYTLYAKINNIFDVKGKDSTSYIKDEMYLPGRNIILGATLTF

SEQ ID NO: 15103 - protein, 662 aa, Escherichia coli H263
MENKGTLFKSISFVAATMVTVSSVAATEQHDNTITVTATKRIQSSFDVIGNVNVQTDEQLKKSLVNQTDDLSAVFPELLSANRSSRIYNNMTLRGQSSADFFSPSLGLFVDGAPQLSQSYAQSLQGVEQVELLKGPQGVIYGRGTLGGIISVITKKPSSHAEAWLGGQYFGQGERINTGGSTGYMENGWAFQGNVSLDRNNGSLNNPAWDKKNVDSRDIKAGWLSANYISPDTLFESNLKVGGENYHSHEEYFVPFSPLSRSKIDTEWLYETPNLKRKLKNISWNTGYDFNDEWKFKTILSYQNMDIDRLFMDGTLQDDSQDILYSEARANYEGGDLSGIIGVSFQKMGYRHDNLSVGKVGMGGKKSDNDIYNYSGYFDGAYRINDNWELGAGARFSHEKAKTRMIILEKGKGESNYNNNAVFNAFIPRASIAWLPNEQNRIWFGVGRGFKPGGFNKEGVDKLALTSYKSEIATEMELGWKWHSVNDNHMAEITLYQIDSKDVQGYVGVIGYQALSNMGDSRSRGIEYLWKSKLTPNHSISLGGMFNQSEFTSGEHKNKRPAYTPSYSSLISWEGLYGKEQKWSSRIAVRFNGPFYFNEQNNLEQGHYTVVDASISWHPTKQYELSIYAKNIGDALYRTYAFGNKAQLGNPREIGVQGSINF

SEQ ID NO: 15104 - protein, 360 aa, Escherichia coli H263; identical to SEQ ID NO: 6702

SEQ ID NO: 15105 - protein, 432 aa, Escherichia coli H263; identical to SEQ ID NO: 5727

SEQ ID NO: 15106 - protein, 276 aa, Escherichia coli H263
MVVIMDPEVLQQAVNDAVAKIPVPADGKSVTADDVRPMIEQMVKDAVSHIPAPRDGRDYDPEVLLRAVNDAVGKLPVPADGKSITPDDVRPMLEQMVTDAVSHIPVPRDGRDYDPEVLQKAVLDAVSALPAPQDGRDATALEIFPAIDEQKSFPRGTYATHQGGLWRAYEKTHGMRGWECLVDGVADIDVSMTGERSFTVVVRQSSGQCTEKTFSLPVMLYRGVFRTGETYHPGDTVTWGGSLWHCNSMTGDKPGEAHSSGWTLAAKRGRDAGGGK

SEQ ID NO: 15107 - protein, 551 aa, Escherichia coli H263; identical to SEQ ID NO: 5885

SEQ ID NO: 15108 - protein, 700 aa, Escherichia coli H263; identical to SEQ ID NO: 7559

SEQ ID NO: 15109 - protein, 111 aa, Escherichia coli H263; identical to SEQ ID NO: 5889

SEQ ID NO: 15110 - protein, 122 aa, Escherichia coli H263; identical to SEQ ID NO: 5737

SEQ ID NO: 15111 - protein, 360 aa, Escherichia coli H263; identical to SEQ ID NO: 5891

SEQ ID NO: 15112 - protein, 673 aa, Escherichia coli H263; identical to SEQ ID NO: 6170

SEQ ID NO: 15113 - protein, 715 aa, Escherichia coli H263; identical to SEQ ID NO: 6806

SEQ ID NO: 15114 - protein, 721 aa, Escherichia coli H263
MKTQITFAALLPALASFIPLHAHASSTSEDEMIVTGNTAADTTDSAAGAGFKTNDIDVGPLGTKSWIETPYSSTTVTKEMIENQQAQSVSEMLKYSPSTQMQARGGMDVGRPQSRGMQGCVVANSRLDGLNIVSTTAFPVEMLERMDVLNSLTGALYGPASPAGQFNFVAKRPTEETLRKVTLGYQSRSAFTGHADLGGHFDENKRFGYRVNLLDQEGEGNVDDSTLRRKLVSVALDWNIQPGTQLQLDASHYEFIQKGYVGSFNYGPNVKLPSAPNPKDKNLALSTAGNDLTTDTISTRLIHYFNDDWSMNAGVGWQQADRAMRSVSSKILNNQGDISRSMKDSTAAGRFRVLSNTAGLNGHIDTGSIGHDLSLSTTGYVWSLYSAKGTGSSYSWGTTNMYHPDAIDEQGDGKIRTGGPRYRSSVNTQQSVTLGDTVTFTPQWSAMFYLSQSWLQTKNYDKHGNQTNQVDENGLSPNAALMYKITPNTMAYVSYADSLEQGGTAPTDESVKNAGQTLNPYRSKQYEVGLKSDIGEMNLGAALFRLERPFAYLDTDNVYKEQGNQVNNGLELTAAGNVWQGLNIYSGVTFLDPKLKDTANASTSNKQVVGVPKVQANLLAEYSLPSIPEWVYSANVHYTGKRAANDTNTSYASSYTTWDLGTRYTTKVSNVPTTFRVVVNNVFDKHYWASIFPSGTDGDNGSPSAFIGGGREVRASVTFDF

SEQ ID NO: 15115 - protein, 826 aa, Escherichia coli H263; identical to SEQ ID NO: 7523

SEQ ID NO: 15116 - protein, 222 aa, Escherichia coli H263
MKGLLALLISSMVLPAHAGIVIYGTRIIYPAEHKEVMVQLMNQGNRSSLMQAWIDDGDTSLPPEKIQVPFMLTPPVAKIGANSGQQVKIMPNKLPTNKESIFYLNVLDIPPNSPEQEGKNALKFAMQNRIKLFYRPAGIAPVNKVTFKKLLVNRSGNGLVIKNDSANWVTISDVKANNVKVNYETIMIAPLESQSVNVKSNNANNWHLTIIDDHGNYISDKI

SEQ ID NO: 15117 - protein, 402 aa, Escherichia coli H263
MIPTRWTKTDLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 15118 - protein, 828 aa, Escherichia coli H263; identical to SEQ ID NO: 7510

SEQ ID NO: 15119 - protein, 162 aa, Escherichia coli H263; identical to SEQ ID NO: 8101

SEQ ID NO: 15120 - protein, 363 aa, Escherichia coli H263; identical to SEQ ID NO: 7508

SEQ ID NO: 15121 - protein, 200 aa, Escherichia coli H263; identical to SEQ ID NO: 5898

SEQ ID NO: 15122 - protein, 274 aa, Escherichia coli H263; identical to SEQ ID NO: 5899

SEQ ID NO: 15123 - protein, 250 aa, Escherichia coli H263; identical to SEQ ID NO: 7503

SEQ ID NO: 15124 - protein, 884 aa, Escherichia coli H263; identical to SEQ ID NO: 7607

SEQ ID NO: 15125 - protein, 518 aa, Escherichia coli H263; identical to SEQ ID NO: 7565

SEQ ID NO: 15126 - protein, 368 aa, Escherichia coli H263
MNKTITALAIMMASFAANASVLPETPVPFKSGTGAIDNDTVYIGLGSAGTAWYKLDTQAKDKKWTALAAFPGGPRDQATSVFIDGDLYVFGGIGKNSKGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGDNLKWNRLAPVSSPDGVAGGFAGISNDSLIFAGGAGFKGSRENYQNGKNYAHEGLKKSYSTDIHLWHNGKWDKSGELSQGRAYGVSLPWNNSLLIIGGESAGGKAVTDSVLISVKDNKVTVQN

SEQ ID NO: 15127 - protein, 241 aa, Escherichia coli H263; identical to SEQ ID NO: 6143

SEQ ID NO: 15128 - protein, 878 aa, Escherichia coli H263
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASISGMNLLADDACVPLTDMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGIYGTLLEDNDLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 15129 - protein, 784 aa, Escherichia coli H263; identical to SEQ ID NO: 6829

SEQ ID NO: 15130 - protein, 161 aa, Escherichia coli H263; identical to SEQ ID NO: 5769

SEQ ID NO: 15131 - protein, 862 aa, Escherichia coli H263; identical to SEQ ID NO: 7497

SEQ ID NO: 15132 - protein, 246 aa, Escherichia coli H263; identical to SEQ ID NO: 5857

SEQ ID NO: 15133 - protein, 747 aa, Escherichia coli H263; identical to SEQ ID NO: 7499

SEQ ID NO: 15134 - protein, 266 aa, Escherichia coli H263; identical to SEQ ID NO: 7500

SEQ ID NO: 15135 - protein, 660 aa, Escherichia coli H263; identical to SEQ ID NO: 6109

SEQ ID NO: 15136 - protein, 250 aa, Escherichia coli H263; identical to SEQ ID NO: 5862

SEQ ID NO: 15137 - protein, 266 aa, Escherichia coli H263; identical to SEQ ID NO: 7595

SEQ ID NO: 15138 - protein, 412 aa, Escherichia coli H263; identical to SEQ ID NO: 7596

SEQ ID NO: 15139 - protein, 645 aa, Escherichia coli H263
MGAANCPGDAKENDASNPWRYVRAATATEITQYGNPASCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSANSIVDYNDAHYKTSVDQDAWGFVPGGDNPWKKYEPAKAWSASTVYVKGDRVVVDGQAYEALFWTQSDNPALIANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKSHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 15140 - protein, 654 aa, Escherichia coli H263; identical to SEQ ID NO: 6816

SEQ ID NO: 15141 - protein, 478 aa, Escherichia coli H263; identical to SEQ ID NO: 6796

SEQ ID NO: 15142 - protein, 237 aa, Escherichia coli H263; identical to SEQ ID NO: 7546

SEQ ID NO: 15143 - protein, 446 aa, Escherichia coli H263; identical to SEQ ID NO: 5873

SEQ ID NO: 15144 - protein, 614 aa, Escherichia coli H263; identical to SEQ ID NO: 7540

SEQ ID NO: 15145 - protein, 208 aa, Escherichia coli H263; identical to SEQ ID NO: 5869

SEQ ID NO: 15146 - protein, 656 aa, Escherichia coli H263; identical to SEQ ID NO: 7573

SEQ ID NO: 15147 - protein, 119 aa, Escherichia coli H263; identical to SEQ ID NO: 5803

SEQ ID NO: 15148 - protein, 753 aa, Escherichia coli H263; identical to SEQ ID NO: 5801

SEQ ID NO: 15149 - protein, 565 aa, Escherichia coli H263
MKSPAPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDNYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAIGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPTTRPLSESTTQPLKQKEAEPTP

SEQ ID NO: 15150 - protein, 656 aa, Escherichia coli H263; identical to SEQ ID NO: 7494

SEQ ID NO: 15151 - protein, 203 aa, Escherichia coli H263; identical to SEQ ID NO: 7450

SEQ ID NO: 15152 - protein, 207 aa, Escherichia coli H263; identical to SEQ ID NO: 7443

SEQ ID NO: 15153 - protein, 237 aa, Escherichia coli H299; identical to SEQ ID NO: 6458

SEQ ID NO: 15154 - protein, 478 aa, Escherichia coli H299; identical to SEQ ID NO: 6796

SEQ ID NO: 15155 - protein, 682 aa, Escherichia coli H299
MKNKYIIAPGIAVMCSAVISSGYASSDKKEDTLVVTASGFTQQLRNAPASVSVITSEQLQKKPVSDLVDAVKDVEGISITGGNEKPDISIRGLSGDYTLILVDGRRQSGRESRPNGSGGFEAGFIPPVEAIERIEVIRGPMSSLYGSDAIGGVINIITKPVNNQTWDGVLGLGGIIQEHGKFGNSTTNDFYLSGPLIKDKLGLQLYGGMNYRKEDSISQGTPAKDNKNITATLQFTPTESQKFVFEYGKNNQVHTLTPGESLDAWTMRGNLKQPNSKRETHNSRSHWVAAWNAQGEILHPEIAVYQEKVIREIKSGKKDKYNHWDLNYESRKPEITNTIIDAKVTAFLPENVLTIGGQFQHAELRDDSATGKKTTETQSVSIKQKAVFIENEYAATDSLALTGGLRLDNHEIYGSYWNPRLYAVYNLTDNLTLKGGIAKAFRAPSIREVSPGFGTLTQGGASIMYGNRDLKPETSVTEEIGIIYSNDSGFSASATLFNTDFKNKLTSYDIGTKDPVTGLNTFIYDNVGEANIRGVELATQIPVYDKWHVSANYTFTDSRRKSDDESLNGKSLKGEPLERTPRHAANAKLEWDYTQDITFYSSLNYTGKQIWAAQRNGAKVPRVRNGFTSMDIGLNYQILPDTLINFAVLNVTDRKSEDIDTIDGNWQVDEGRRYWANVRVSF

SEQ ID NO: 15156 - protein, 656 aa, Escherichia coli H299
MYMNVIRTVICTLIIVPVGLQAATSHSSMAKDTITIVATGNQNTVFETPSMVSVVTNDTPWSQNAVTSAGMLKGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGERAPNKEKPAALFAKGSVGITDSNKAGASLRLYRNNTTEPGNPTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTDNDRLQLKGGYFGTDARNYIATRVDMKRMRSYSYNVSRARIWGWDMQGNYQSDYVDWVLSYNRTESMDASSREWLGSGNPDTLISDISIPVGHRGVYAGWRAELSASATHVKKGDSYQAGYAIHSFSLSYKPVSVKGFEASVTLDNAFNKLAMNGKGVPLSGRTVSLYTRYQW

SEQ ID NO: 15157 - protein, 774 aa, Escherichia coli H299
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWDARVAYDFGPQMADLNLAFGVKNIFDQDYFIRSYNDNNKGIYAGQPRTLYMQGSLKF

SEQ ID NO: 15158 - protein, 368 aa, Escherichia coli H299
MNKTITALTIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGDNLKWNKLDPVSSPDGVAGGFAGISNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 15159 - protein, 241 aa, Escherichia coli H299; identical to SEQ ID NO: 6143

SEQ ID NO: 15160 - protein, 878 aa, Escherichia coli H299
MSYLNLRLYQRNTQCLHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGSNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTNNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 15161 - protein, 784 aa, Escherichia coli H299
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWKHSGVMDQVWRFNVDYTKVSDPSYFNDFDNKYGSSTDGYATQKFSIGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTRLAESANRVMPQFKVDGRMVFERDMEMLAPGYTQTLEPRAQYLYVPYRDQSKIYNYDSSLLQSDYSGLFRDRTYGGLDRIASANQVTTGVTSRIYDDAAVERFNISVGQIYYFTESRTGDDNITWENDDKTGSLVWAGDTYWRISDRWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 15162 - protein, 866 aa, Escherichia coli H299
MTIKSTKKYHNHLTRIATFCALLYSNSALCAELVEYDHTFLMGKDASNIDLSRYTEGNPTLPGIYDVSVYVNDQPIMSQSIAFTVIEGKKNAQACITQKNLLQFHISSPDKNSEKAILLKRDEDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNTTSEKIAQSIILNGLRCQIQ

SEQ ID NO: 15163 - protein, 246 aa, Escherichia coli H299
MFFNTKHTAALCLASCMAFSSSAIADIVISGTRVVYKSEQKSVNVRLENKGNNPLLVQSWLDTGDDNAEPGSITVPFTATPPVSRIDAKRGQTIKLMYTASSALPKDRESVFWFNVLEVPPKPDAAKAANQSLLQLAFRTRIKLFYRPEGLSGIPSDAPLALKWSWATSEGKAALRVDNPTPYYVSFSSGDLEANGKRYPLDVKMIAPFSNDVIKVNGMSGRTSSAKVHFFAINDFGGSIEGNANL

SEQ ID NO: 15164 - protein, 729 aa, Escherichia coli H299
MARSKTAQPKHSLRKIAVVVATAVSGMSVYAQAAVEPKEDTITVTAAPAPQESAWGPAATIAAKHSATATKTDTPIEKTPQSISVVTNEEIQMHQFQSVKEALGYTPGVTVSSRGASNTYDFVIIRGFSSVGLNQNNYLDGLKLQGNFYNDAVIDPYMLERVELMRGPTSVLYGKSNPGGIISMVSKRPTTEPLKEIQFKMGTDNLFQTGFDFSDALDDNGEFSYRLTGLARSTNEQQKNSESQRYTIAPSFSWRPDDKTNFTFLSYFQNEPETGYYGWLPKEGTVEPLPNGKRLPTDFNEGASNNTYSRNQKMVGYSFEHGFNDTFTVRQNLRFSEMKTSQKSVYGTGIASDGHTLNRGTVVDNERLQNFSVDTQLESKFATGEVEHTLLTGVDFMRMRNDINASFGSAPSIDLYNKYHPEYFAFGNAEPYQMNESKQTGIYVQDQAEWNKWVFTLGGRYDWSKQATTVRENSYTPTEGYIERNDHQFTWRGGVNYLFDNGISPYFSYSQSFEPSAFDLWSNPRVSYKPSKGEQYEAGVKYVPNDMPVVVTGAVYQLTKTNNLTADPTNPLAQVPAGEIRARGVELEAKAALNANINLTASYTYTDAEYTKDTNLKGKTPEQVPEHMASLWGDYTFNEGPLSGLTLGTGGRFIGSSYGDPANTFKVGSAAVMDAVVKYDLARFGMAGSSLAVNVNNLLDREYVASCFQTYGCFWGAERQVVATATFRF

SEQ ID NO: 15165 - protein, 266 aa, Escherichia coli H299
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLVPWSPQPDKAEQAAQSLLDQYAQLKAQYADKPKKRVFLQFGINPPFTSGKESIQNQVLEVCGGENIFKDSRVPWPQVSREQVLARAPQAIVITGGPDQIPKIKQYWGEQLKIPVIPLTSDWFERASPRIILAAQQLCNALSQVD

SEQ ID NO: 15166 - protein, 161 aa, Escherichia coli H299; identical to SEQ ID NO: 5769

SEQ ID NO: 15167 - protein, 351 aa, Escherichia coli H299; identical to SEQ ID NO: 8304

SEQ ID NO: 15168 - protein, 746 aa, Escherichia coli H299; identical to SEQ ID NO: 8052

SEQ ID NO: 15169 - protein, 193 aa, Escherichia coli H299; identical to SEQ ID NO: 6300

SEQ ID NO: 15170 - protein, 243 aa, Escherichia coli H299
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPSPEKNSGHAVLQVAIQSRIKVFWRPAALRKKAGEKVELQLQVSQQGNQLTLKNPTAYYLTIAYLGRNEKGVLPGFKTVMVAPFSTVITNTGSYSGSQFYLGYMDDYGALRMTTLNCSGQCRLQAVEAKK

SEQ ID NO: 15171 - protein, 816 aa, Escherichia coli H299
MNIYRLSFISCLVMAIPSALAVEFNLNVLDKSMRDRIDISLLKEKGGIAPGEYFVSVTVNNNQISNGQKIDWKKNGDQTIPCINDLLVDKFGLKPEVRQSLPRLNQCVDFSSRPEILFIFDQASQQLNITIPQAWLAWHSDNWTPPSTWKEGVAGVLMDYNLFASSYRPQDGSNSTNLNAYGTAGINAGAWRLRSDYQLNQTDSDDNHEQSGEISRTYLFRPLPQLGSKLTLGETDFSSNIFDGFSYTGAALASDDRMLPWELRGYAPQISGIAQTNATVTVSHSGRVIYQKKVPPGPFIIDDLNQSVQGTLDVKVTEEDGRANNFQVSAASTPFLTRQGQVRYKLAAGQPRTSMSHQTENETFFSNEVSWGMLSNTSLYGGLLISGDDYHSAAMGIGQNMLWLGALSFDVTWASSQFDTQQDERGLSYRFNYSKQVDATDSTISLAAYRFSDRHFHSYANYLDHKYNNSDAQDEKQTISLSVGQPITPLNLNLYANLLHQTWWNADASTTANITAGFNVDIGNWRDISISTSFNTTHYEDKDRDNQIYLSISLPFGNGGRVGYDMQNSSHSTTHRMSWNDTLDERNSWGMSTGLQSDRPDNGVQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDNSGISVGMVGEEGHAWLSGVAENQMLTVVWGDSQHCSLHLPEHMEDTANRLILPCH

SEQ ID NO: 15172 - protein, 430 aa, Escherichia coli H299; identical to SEQ ID NO: 5758

SEQ ID NO: 15173 - protein, 365 aa, Escherichia coli H299; identical to SEQ ID NO: 7178

SEQ ID NO: 15174 - protein, 203 aa, Escherichia coli H299; identical to SEQ ID NO: 6414

SEQ ID NO: 15175 - protein, 362 aa, Escherichia coli H299; identical to SEQ ID NO: 5813

SEQ ID NO: 15176 - protein, 517 aa, Escherichia coli H299; identical to SEQ ID NO: 6817

SEQ ID NO: 15177 - protein, 191 aa, Escherichia coli H299; identical to SEQ ID NO: 5748

SEQ ID NO: 15178 - protein, 232 aa, Escherichia coli H299; identical to SEQ ID NO: 5747

SEQ ID NO: 15179 - protein, 729 aa, Escherichia coli H299
MLSTQFNRDNQYQTTSKPSLLAACIALALLPSAAFAAPATEETVIVEGSATTPVDDENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWAYIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 15180 - protein, 213 aa, Escherichia coli H299
MTKMSRYALITALAMFLAGCVGQRESAPVEEVKPAPEQPAEPQQPVPTVPSVPTIPQQPGPIEHEDQTAPPAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 15181 - protein, 656 aa, Escherichia coli H299; identical to SEQ ID NO: 8625

SEQ ID NO: 15182 - protein, 565 aa, Escherichia coli H299
MKSPAASRPLKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILSRASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 15183 - protein, 207 aa, Escherichia coli H299; identical to SEQ ID NO: 7443

SEQ ID NO: 15184 - protein, 541 aa, Escherichia coli H299
MAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTDFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 15185 - protein, 700 aa, Escherichia coli H299
MKIFSVRQTVFPALLVLSPTVFAADEQTMIVSAAPQVISELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVITQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMSPQLNPSHAGGVITLQRHYQGIDSRWTHRGELGVPVTFTTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGMNIAWRFE

SEQ ID NO: 15186 - protein, 332 aa, Escherichia coli H299; identical to SEQ ID NO: 5757

SEQ ID NO: 15187 - protein, 871 aa, Escherichia coli H299
MHQVLLLPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVSDNSACTPLRDRLADASSEFNVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSIKSVYSKSFYQTGTNIQVAGYRYSTQGFYNLSDSAYSRMSGYTVKPPTGDSNEKTQFIDYFNLFYSKRGQEQISISQQLGNYGTTFFSASRQSYWNTSRSDQQISFGLNVPFSDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNIGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 15188 - protein, 236 aa, Escherichia coli H299; identical to SEQ ID NO: 7814

SEQ ID NO: 15189 - protein, 118 aa, Escherichia coli H299 [sequence omitted]

SEQ ID NO: 15190 - protein, 721 aa, Escherichia coli H299; identical to SEQ ID NO: 6807

SEQ ID NO: 15191 - protein, 274 aa, Escherichia coli H299
MNKTAIVLLALLASSASLAATPWQKITQPVPGSAQSIGSFSNGCIVGADTLPIQSEHYQVMRTDQRRYFGHPDLVMFIQRLSRQVSNLGMGTVLIGDMGMPAGGRFNGGHASHQTGLDVDIFLQLPKTRWTSAQLLRPQALDLVSRDGKHVVPTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 15192 - protein, 249 aa, Escherichia coli H299
MTKHLSVKTLATVLSLLAATVSFSALASVTPDRTRLIFNESDKSISVTLRNNDPKQPYLAQSWIEDEKGVKISSPLAVLPPVQRIDAMMNGQVKIQGLPDIHKLPADRESIFYFNVREIPPKSNKANTLQIALQTRIKLFWRPKALEKASMQNPWQHKVTLTRNGQEFTVNNPTPYYVIFSNASAQKNGNPADGFSPIVMSPKTSAPLKVKMASVPVLTYVNDYGARMPLFFTCSGNSCQVDEEQSRKG

SEQ ID NO: 15193 - protein, 879 aa, Escherichia coli H299
MPEHSFLRLRGLSWWIALAISGSPFNVLADDTIQFDARFLELKGNTKIDLGRFSQKGYVEPGKYNLRVHVNNHPLPDEYDIYWYVAENDPNKSYACLPPELIAQFGFKDDFAKSLQWGHDGQCLKTDQIGGMEIKGDLSQSALLVSVPQAYLEYTDDDWDPPSRWDEGIPGLIADYSINAQTRHENGGDDTNDISGNGTVGVNVGPWRLRADWQSDYQHTRSNDDGDTDDSGTQKNWEWSRYYAWRALPSLKAKLSLGEDYLNSDIFDGFSYIGGSISTDDQMLPPNMRGYAPDISGVAHTTAKVTVTQMGRVIYETQVPAGPFRIQDIGDSVSGTLHVRIEEQNGQVQEYDVSTASMPFLTRPGQVRYKVTMGRPQNWDHQVAGSFFSGGEASWGIANGWSLYGGALADENYQSAALGLGRDLALFGALAFDVTHSRVQLDDNSVYGNKTLDGNSYRVSYAKDFDELNSRVTFAGYRFSEKNYMTMSEYLDANDTDRARTGNDKEMYTVTYNQNFRDARVSVYLNYSHHTYWDREDQTNYNMMLSHYFNLGSLRNLSVSLTGYRYEYDKSADKGVYLSLSLPWGDNSTISYNGNYGSGADSSQASLYHRIDDASHYTLSAGTSENHTSLDGYYSHDGTLAKVDLSANYHEGQYTSAGVSLQGGVTLTAHGGALHRTQNMGGTRLLIDADGVANVPVEGNGSAVYTNMFGKAVVADVNDYYRNQAYIDLNKLPENAEATQSVVQATLTEGAIGYRKFAVISGEKAMVVLRLQDGSHPPFGAEVKNDNQQQVGLVDDEGNVYLAGVKPGEHMTVFWEGESHCDISLPDPLPNDLFNGLLLPCQQKGGSAPVITHDIQPVIQEQTQQVTPMEPPMSVSSNQ

SEQ ID NO: 15194 - protein, 518 aa, Escherichia coli H299
MKKLKINYLFIGILALLLAVALWPSIPWFGKADNRIAAIQARGELRVSTIHTPLTYNEINGKPVGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 15195 - protein, 673 aa, Escherichia coli H299
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHDNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 15196 - protein, 826 aa, Escherichia coli H299; identical to SEQ ID NO: 9108

SEQ ID NO: 15197 - protein, 213 aa, Escherichia coli H299; identical to SEQ ID NO: 12304

SEQ ID NO: 15198 - protein, 828 aa, Escherichia coli H299; identical to SEQ ID NO: 7891

SEQ ID NO: 15199 - protein, 162 aa, Escherichia coli H299; identical to SEQ ID NO: 5896

SEQ ID NO: 15200 - protein, 375 aa, Escherichia coli H299
MKVKVLSLLVPALLVAGAANAAEVYNKDGNKLDLYGKVDGLHYFSDDKSVDGDQTYMRLGFKGETQVTDQLTGYGQWEYQIQGNAPESENNSWTRVAFAGLKFQDIGSIDYGRNYGVVYDVTSWTDVLPEFGGDTYGSDNFMQQRGNGFATYRNTDFFGLVDGLNFAVQYQGQNGSVSGESDPDFTGHGITNNGRKALRQNGDGVGGSITYDYEGFGIGGAISSSKRTWDQNNTGLIGTGDRAETYTGGLKYDANNIYLAAQYTQTYNATRVGSLGWANKAQNFEAVAQYQFDFGLRPSVAYLQSKGKNLGTIGTRNYDDEDILKYVDVGATYYFNKNMSTYVDYKINLLDDNQFTRDAGINTDNIVALGLVYQF

SEQ ID NO: 15201 - protein, 200 aa, Escherichia coli H299; identical to SEQ ID NO: 14080

SEQ ID NO: 15202 - protein, 432 aa, Escherichia coli H299; identical to SEQ ID NO: 5727

SEQ ID NO: 15203 - protein, 359 aa, Escherichia coli H299; identical to SEQ ID NO: 5847

SEQ ID NO: 15204 - protein, 686 aa, Escherichia coli H299
MFWRDMTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLTLMPHTAQPILPAQNQALPPEVRAFLNAGRTR

SEQ ID NO: 15205 - protein, 713 aa, Escherichia coli H299; identical to SEQ ID NO: 11059

SEQ ID NO: 15206 - protein, 222 aa, Escherichia coli H299; identical to SEQ ID NO: 8389

SEQ ID NO: 15207 - protein, 678 aa, Escherichia coli H299
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSELTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 15208 - protein, 654 aa, Escherichia coli H299
MDSVMKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNERKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHTPAPSAR

SEQ ID NO: 15209 - protein, 900 aa, Escherichia coli H299
MKLNIFTKSMIGMGLVCSALPALAMEVWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNSGAVTPVDPTPETPVTPVTPTPDNNEPSTPADSSNDYSLQAWSGQEGSEIYHVIFNGNVYQNAWWVGSEDCPRGTSAENSNNPWRLVRTATAAEMSQYGNPTTCEIDNGGVIVADGFQASKAYSANSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGANYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 15210 - protein, 412 aa, Escherichia coli H299
MKQWIAALLLMLIPGVQAAKPQKVTLMVDDVPVAQVLQALAEQEKLNLVVSPDVSGTVSLHLTDVPWKQALQTVVKSAGLITRQEGNILSVHSVAWQNDNIARQEAEQTRAQANLPLENRNITLQYADAGELAKAGEKLLSAKGSMTVDKRTNRLLLRDNKAALSALEQWVAQMDLPVGQVELSAHIVTINEKSLRELGVKWTLADAQHAGGVGQVTALGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 15211 - protein, 259 aa, Escherichia coli H299
MRQYRLLSPMIKVVIVLFSLLFSTAQAGLVIGGTRFAYPENQSSISVELKNTSDRDMLVKVAVSPDDARQLTGTVESLPSYSETVFIATPPLFVLKPDKNTKIRINRVGGSLPTDRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGICEITWQTLDIYNNVLPALKVNMNPLQMDVSGSQFKTD

SEQ ID NO: 15212 - protein, 250 aa, Escherichia coli H299
MKCIIGNKKWVYGFRDELKISQNIIRSGILFLLSILFINNASAGGFGLGVTRLIYPAESKQITLSVQNSGDNTSYLIQSWVDDSKTEKKSQDFVITPPLFMLPTRKEASLRIMFLGKTNLPTDRETLYWMNVKAIPPTDEKNTQKNTLQLALQNKIKLFYRPENLPVQPGKARNMLRFKYEGKQLKVINPSPYYLTLTGIKVQGSKLPNTFVPPKSDITVSSAVTLAGEITYQTINDFGATTERQKGIMQ

SEQ ID NO: 15213 - protein, 660 aa, Escherichia coli H299
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQAVEASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 15214 - protein, 244 aa, Escherichia coli H299; identical to SEQ ID NO: 6111

SEQ ID NO: 15215 - protein, 836 aa, Escherichia coli H299
MKDRIPFAVNNITCVILLSLFCNAASAVEFNTDVLDAADKKNIDFTRFSEAGYVLPGQYLLDVIVNGQSISPASLQISFVEPALSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNITSVDLKRLPDDVEATRSVVESALTEGAIGYRKFSVLKGKRLFAILRLADGSQPPFGASVTSEKGRELGMVADEGLAWLSGVTPGETLSVNWDEKIQCQVNVPETAISDQQLLLPCTPQK

SEQ ID NO: 15216 - protein, 243 aa, Escherichia coli H299
MSRKSCLIRLFKTTVSCKLFTAIILSVFLVQPALTYAGVVIGGTRVVYLSNNPDKSISVFSKEEKIPYLIQAWVDPFNKEDKIKAPFTVIPPVSRLEPAQEKVLRIIHTKGVSLPDDRESVFWLNIKNIPPSASNKAANSLEIAVKTRIKLFWRPASIRLIPEDAAPKVKWHREGRNLIAENPNPIHISVMDVIVDGHDVPLNMIRPFETLTLPLPANSAGGQMIWRFINDYGAVSDPIKMTL

SEQ ID NO: 15217 - protein, 208 aa, Escherichia coli H299; identical to SEQ ID NO: 5869

SEQ ID NO: 15218 - protein, 614 aa, Escherichia coli H299
MIKKASLLTACSVTAFSAWAQDTSPDTLVVTANRFQEPLSAVLAPVTVVTREDIERWQVSSVNDVLRRLPGVAIAQNGGEGQLSTIFIRGTNSNHALVLIDGVRLNLAGVSGSADLSQFPIALVQRIEYIRGPRSAIYGSDAIGGVINIITSRENTGTEISAGWGSNSYQNYDISTQQQIGENTQVTLLGDYAYTRGFDVVAYGNTGMQPQSDRDGFLSKTLYGKLEHNFSDTWSGFVRGYGYDNRTKYDAWYSPGSPLIDTRKLYSQSWDAGLRYAGETLQSQLVSSYSHSKDYNYDPHYGRYDASANLDEMKQYNLQWTNSVTVGHGDVGAGIDWQKQSTTPGTGYLPKGYDQRNTGIYLTGLQKVGDFTLEGAVRNDDNSQFDRHTTWQSSVGWEFIEGYRFIASYGTAFKAPNLGQLYGYKGNPNLDPEKSKQWEGAFEGLTAGVNWRISGYRNDISDMINCTQNCERYYNDAKVHIKGIESTANFETGPLVHTVSYDYTDARNALTDKPLERRPKQQVKYQLDWQVFDFDWGVTYQYLGSRYDSDYSSWPYKSVKMGGVSLWDLAVAYPVTSHLTVRGKIANLFDKDYETVYGYQTAGREYTLSGSYTF

SEQ ID NO: 15219 - protein, 446 aa, Escherichia coli H299; identical to SEQ ID NO: 5873

SEQ ID NO: 15220 - protein, 243 aa, Escherichia coli H299
MKTFIFFIFTLLSFNTDAVQFVYRVDSRPPDVVFREGFRSHGANRNLQQHVRGDSCAAGSRDSAFIATTADINETYSIARQYFSSSTFHGNLYRYRIRANHEFYSLEPSVQLLRGRGVTFSRFEDIMMREQSEIVADGFIPTENIAEAIQLRYDRTSGVVSDGSGTSNPRYLNISTDSNPGVIPNIPVPQVSVRARINAFGSLLTACFSLRGTRDGGVYRSSNYYEEFYDARPLLKVLLVNGS

SEQ ID NO: 15221 - protein, 121 aa, Escherichia coli H299; identical to SEQ ID NO: 6175

SEQ ID NO: 15222 - protein, 714 aa, Escherichia coli H299
MAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYTSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 15223 - protein, 725 aa, Escherichia coli H299
MRTHKLLWPLTALLVGFNSQVSVAKSSDDDNDETLVVEATAEQILKQQPGVSVITSEDIKKSPPVNDISDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHASLSLYTNQPESSDEGATRRANFSLSGPMAGNALTTRLYGNLNKTDADSWDINSPVGTKNAAGHEGVRNKDINGVVSWKLNPQQILDFEAGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDRDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 15224 - protein, 518 aa, Escherichia coli H397; identical to SEQ ID NO: 7565

SEQ ID NO: 15225 - protein, 781 aa, Escherichia coli H397; identical to SEQ ID NO: 8761

SEQ ID NO: 15226 - protein, 250 aa, Escherichia coli H397; identical to SEQ ID NO: 7503

SEQ ID NO: 15227 - protein, 274 aa, Escherichia coli H397; identical to SEQ ID NO: 5899

SEQ ID NO: 15228 - protein, 200 aa, Escherichia coli H397; identical to SEQ ID NO: 5898

SEQ ID NO: 15229 - protein, 363 aa, Escherichia coli H397; identical to SEQ ID NO: 7508

SEQ ID NO: 15230 - protein, 162 aa, Escherichia coli H397; identical to SEQ ID NO: 8101

SEQ ID NO: 15231 - protein, 828 aa, Escherichia coli H397; identical to SEQ ID NO: 7510

SEQ ID NO: 15232 - protein, 663 aa, Escherichia coli H397; identical to SEQ ID NO: 5894

SEQ ID NO: 15233 - protein, 222 aa, Escherichia coli H397; identical to SEQ ID NO: 15116

SEQ ID NO: 15234 - protein, 826 aa, Escherichia coli H397; identical to SEQ ID NO: 7523

SEQ ID NO: 15235 - protein, 721 aa, Escherichia coli H397; identical to SEQ ID NO: 15114

SEQ ID NO: 15236 - protein, 715 aa, Escherichia coli H397; identical to SEQ ID NO: 6806

SEQ ID NO: 15237 - protein, 673 aa, Escherichia coli H397; identical to SEQ ID NO: 6170

SEQ ID NO: 15238 - protein, 360 aa, Escherichia coli H397; identical to SEQ ID NO: 5891

SEQ ID NO: 15239 - protein, 118 aa, Escherichia coli H397
MKKRGAFLGLLLVSACASVFAANNETSKSVTFPKCEGLDAAGIAASVKRDYQQNRVARWADDQIIVGQADPVAWVSLQDIQGKDDKWSVPLTVRGKSADIHYQVSVDCKAGMAEYQRR

SEQ ID NO: 15240 - protein, 102 aa, Escherichia coli H397; identical to SEQ ID NO: 14041

SEQ ID NO: 15241 - protein, 236 aa, Escherichia coli H397; identical to SEQ ID NO: 7624

SEQ ID NO: 15242 - protein, 883 aa, Escherichia coli H397
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGNLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTQGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVDYKLPVVSPGTLLNQQTAICR

SEQ ID NO: 15243 - protein, 700 aa, Escherichia coli H397; identical to SEQ ID NO: 7559

SEQ ID NO: 15244 - protein, 539 aa, Escherichia coli H397; identical to SEQ ID NO: 7564

SEQ ID NO: 15245 - protein, 351 aa, Escherichia coli H397; identical to SEQ ID NO: 7560

SEQ ID NO: 15246 - protein, 746 aa, Escherichia coli H397; identical to SEQ ID NO: 6783

SEQ ID NO: 15247 - protein, 193 aa, Escherichia coli H397; identical to SEQ ID NO: 6300

SEQ ID NO: 15248 - protein, 430 aa, Escherichia coli H397; identical to SEQ ID NO: 5758

SEQ ID NO: 15249 - protein, 331 aa, Escherichia coli H397; identical to SEQ ID NO: 7536

SEQ ID NO: 15250 - protein, 760 aa, Escherichia coli H397; identical to SEQ ID NO: 7535

SEQ ID NO: 15251 - protein, 203 aa, Escherichia coli H397; identical to SEQ ID NO: 6414

SEQ ID NO: 15252 - protein, 362 aa, Escherichia coli H397; identical to SEQ ID NO: 5874

SEQ ID NO: 15253 - protein, 232 aa, Escherichia coli H397; identical to SEQ ID NO: 5747

SEQ ID NO: 15254 - protein, 729 aa, Escherichia coli H397; identical to SEQ ID NO: 6821

SEQ ID NO: 15255 - protein, 213 aa, Escherichia coli H397; identical to SEQ ID NO: 5744

SEQ ID NO: 15256 - protein, 360 aa, Escherichia coli H397; identical to SEQ ID NO: 5879

SEQ ID NO: 15257 - protein, 191 aa, Escherichia coli H397; identical to SEQ ID NO: 5748

SEQ ID NO: 15258 - protein, 203 aa, Escherichia coli H397; identical to SEQ ID NO: 7450

SEQ ID NO: 15259 - protein, 656 aa, Escherichia coli H397; identical to SEQ ID NO: 7494

SEQ ID NO: 15260 - protein, 565 aa, Escherichia coli H397; identical to SEQ ID NO: 7493

SEQ ID NO: 15261 - protein, 207 aa, Escherichia coli H397; identical to SEQ ID NO: 7443

SEQ ID NO: 15262 - protein, 161 aa, Escherichia coli H397; identical to SEQ ID NO: 5769

SEQ ID NO: 15263 - protein, 266 aa, Escherichia coli H397; identical to SEQ ID NO: 7500

SEQ ID NO: 15264 - protein, 747 aa, Escherichia coli H397
MAPSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPDNSGPYRILNKQKQTGVYVQDQAQWDKVLVTLGGRYDWADQESLNRVAGTTDKRDDKQFTWRGGVNYLFDNGVTPYFSYSESFELSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 15265 - protein, 246 aa, Escherichia coli H397; identical to SEQ ID NO: 5857

SEQ ID NO: 15266 - protein, 862 aa, Escherichia coli H397; identical to SEQ ID NO: 7497

SEQ ID NO: 15267 - protein, 784 aa, Escherichia coli H397; identical to SEQ ID NO: 6829

SEQ ID NO: 15268 - protein, 878 aa, Escherichia coli H397
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASISGMNLLADDACVPLTDMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTTQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGIYGTLLEDNDLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 15269 - protein, 241 aa, Escherichia coli H397; identical to SEQ ID NO: 6143

SEQ ID NO: 15270 - protein, 368 aa, Escherichia coli H397; identical to SEQ ID NO: 15126

SEQ ID NO: 15271 - protein, 478 aa, Escherichia coli H397; identical to SEQ ID NO: 6796

SEQ ID NO: 15272 - protein, 237 aa, Escherichia coli H397; identical to SEQ ID NO: 7546

SEQ ID NO: 15273 - protein, 445 aa, Escherichia coli H397; identical to SEQ ID NO: 7541

SEQ ID NO: 15274 - protein, 432 aa, Escherichia coli H397; identical to SEQ ID NO: 5727

SEQ ID NO: 15275 - protein, 359 aa, Escherichia coli H397; identical to SEQ ID NO: 5847

SEQ ID NO: 15276 - protein, 686 aa, Escherichia coli H397; identical to SEQ ID NO: 7542

SEQ ID NO: 15277 - protein, 713 aa, Escherichia coli H397; identical to SEQ ID NO: 6056

SEQ ID NO: 15278 - protein, 222 aa, Escherichia coli H397; identical to SEQ ID NO: 7531

SEQ ID NO: 15279 - protein, 840 aa, Escherichia coli H397; identical to SEQ ID NO: 7530

SEQ ID NO: 15280 - protein, 246 aa, Escherichia coli H397; identical to SEQ ID NO: 15094

SEQ ID NO: 15281 - protein, 678 aa, Escherichia coli H397
MVPSTFSRLKAARCLPVVLAALIFAGCGTHTPDQSTAYMQGTAQADSAFYLQQMQQSSDDTRINWQLLAIRALVKEGKTGQAVELFNQLPQELNDTQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKLASTNKIALLLPLNGQAAVFGRTIQQGFEAAKNIGTQPVVAQVAAAPAADVAEQPQPQTVDGVASPAQASVSDLTGEQPAAQSVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRETTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 15282 - protein, 650 aa, Escherichia coli H397
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNSRKPSSTSAMDNVAITADEQTNSLVITADQSVQEKLATVIARLDIRRAQVLVEAIIVEVQDGNGLNLGVQWANKNVGAQQFTNTGLPVFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTVIRDDDVYRSLSKEKYTRYRQEQQLRIDGKSKALIGSEDLPVLDENTFNSHAPAPSSR

SEQ ID NO: 15283 - protein, 900 aa, Escherichia coli H397; identical to SEQ ID NO: 7567

SEQ ID NO: 15284 - protein, 412 aa, Escherichia coli H397; identical to SEQ ID NO: 7596

SEQ ID NO: 15285 - protein, 259 aa, Escherichia coli H397; identical to SEQ ID NO: 8776

SEQ ID NO: 15286 - protein, 250 aa, Escherichia coli H397; identical to SEQ ID NO: 5862

SEQ ID NO: 15287 - protein, 660 aa, Escherichia coli H397; identical to SEQ ID NO: 6109

SEQ ID NO: 15288 - protein, 614 aa, Escherichia coli H397; identical to SEQ ID NO: 7540

SEQ ID NO: 15289 - protein, 208 aa, Escherichia coli H397; identical to SEQ ID NO: 5869

SEQ ID NO: 15290 - protein, 656 aa, Escherichia coli H397; identical to SEQ ID NO: 7573

SEQ ID NO: 15291 - protein, 753 aa, Escherichia coli H397; identical to SEQ ID NO: 5801

SEQ ID NO: 15292 - protein, 119 aa, Escherichia coli H397; identical to SEQ ID NO: 5803

SEQ ID NO: 15293 - protein, 351 aa, Escherichia coli H489; identical to SEQ ID NO: 5767

SEQ ID NO: 15294 - protein, 230 aa, Escherichia coli H489; identical to SEQ ID NO: 6360

SEQ ID NO: 15295 - protein, 869 aa, Escherichia coli H489; identical to SEQ ID NO: 6711

SEQ ID NO: 15296 - protein, 360 aa, Escherichia coli H489; identical to SEQ ID NO: 5879

SEQ ID NO: 15297 - protein, 746 aa, Escherichia coli H489; identical to SEQ ID NO: 6710

SEQ ID NO: 15298 - protein, 193 aa, Escherichia coli H489; identical to SEQ ID NO: 6300

SEQ ID NO: 15299 - protein, 243 aa, Escherichia coli H489; identical to SEQ ID NO: 6708

SEQ ID NO: 15300 - protein, 816 aa, Escherichia coli H489; identical to SEQ ID NO: 6649

SEQ ID NO: 15301 - protein, 431 aa, Escherichia coli H489; identical to SEQ ID NO: 6791

SEQ ID NO: 15302 - protein, 331 aa, Escherichia coli H489; identical to SEQ ID NO: 6551

SEQ ID NO: 15303 - protein, 760 aa, Escherichia coli H489; identical to SEQ ID NO: 6703

SEQ ID NO: 15304 - protein, 203 aa, Escherichia coli H489; identical to SEQ ID NO: 6414

SEQ ID NO: 15305 - protein, 362 aa, Escherichia coli H489; identical to SEQ ID NO: 5809

SEQ ID NO: 15306 - protein, 224 aa, Escherichia coli H489; identical to SEQ ID NO: 7705

SEQ ID NO: 15307 - protein, 851 aa, Escherichia coli H489
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESEFAQATLQWGGPWGTTWYGGGQYAEYYRAAMFGLGFNFGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGVQANSGIIDDDGSLYMAGLPAKGTISVRWGEAPDQICHINYELTEQQINSAITRMDAICR

SEQ ID NO: 15308 - protein, 229 aa, Escherichia coli H489; identical to SEQ ID NO: 7707

SEQ ID NO: 15309 - protein, 517 aa, Escherichia coli H489; identical to SEQ ID NO: 6406

SEQ ID NO: 15310 - protein, 191 aa, Escherichia coli H489; identical to SEQ ID NO: 5748

SEQ ID NO: 15311 - protein, 232 aa, Escherichia coli H489; identical to SEQ ID NO: 5747

SEQ ID NO: 15312 - protein, 729 aa, Escherichia coli H489; identical to SEQ ID NO: 6531

SEQ ID NO: 15313 - protein, 213 aa, Escherichia coli H489; identical to SEQ ID NO: 5744

SEQ ID NO: 15314 - protein, 203 aa, Escherichia coli H489; identical to SEQ ID NO: 6396

SEQ ID NO: 15315 - protein, 565 aa, Escherichia coli H489; identical to SEQ ID NO: 6395

SEQ ID NO: 15316 - protein, 207 aa, Escherichia coli H489; identical to SEQ ID NO: 5743

SEQ ID NO: 15317 - protein, 551 aa, Escherichia coli H489; identical to SEQ ID NO: 6971

SEQ ID NO: 15318 - protein, 700 aa, Escherichia coli H489
MKIFSVRQTVLPALLALSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERRLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDADVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 15319 - protein, 111 aa, Escherichia coli H489; identical to SEQ ID NO: 7676

SEQ ID NO: 15320 - protein, 130 aa, Escherichia coli H489; identical to SEQ ID NO: 7726

SEQ ID NO: 15321 - protein, 673 aa, Escherichia coli H489; identical to SEQ ID NO: 6170

SEQ ID NO: 15322 - protein, 826 aa, Escherichia coli H489; identical to SEQ ID NO: 6373

SEQ ID NO: 15323 - protein, 239 aa, Escherichia coli H489; identical to SEQ ID NO: 6428

SEQ ID NO: 15324 - protein, 663 aa, Escherichia coli H489; identical to SEQ ID NO: 6307

SEQ ID NO: 15325 - protein, 828 aa, Escherichia coli H489; identical to SEQ ID NO: 6558

SEQ ID NO: 15326 - protein, 162 aa, Escherichia coli H489; identical to SEQ ID NO: 6365

SEQ ID NO: 15327 - protein, 367 aa, Escherichia coli H489; identical to SEQ ID NO: 5789

SEQ ID NO: 15328 - protein, 200 aa, Escherichia coli H489; identical to SEQ ID NO: 6363

SEQ ID NO: 15329 - protein, 274 aa, Escherichia coli H489; identical to SEQ ID NO: 6362

SEQ ID NO: 15330 - protein, 250 aa, Escherichia coli H489; identical to SEQ ID NO: 6714

SEQ ID NO: 15331 - protein, 881 aa, Escherichia coli H489; identical to SEQ ID NO: 6713

SEQ ID NO: 15332 - protein, 510 aa, Escherichia coli H489; identical to SEQ ID NO: 6653

SEQ ID NO: 15333 - protein, 678 aa, Escherichia coli H489
MVPSTFSRLKAARCLPVVLAALIFAGCGTHTPDQSTDYMQGTAQADSAFYLQQMQQSSDDTRINWQLLAIRALVKEGKTGQAVELFNQLPQELNDAQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQIAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRNLSWLQYQQGQVVPVS

SEQ ID NO: 15334 - protein, 813 aa, Escherichia coli H489
MVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSRLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 15335 - protein, 170 aa, Escherichia coli H489
MVRLNPSEQIQIRMITQKKIAQLPKDRETLFYFNVREIPPKTDKKNVMQVTMQHALKLFWRPKAIELEDDGVMTYEKVEIIRRNDGSIRFNNKMPYHVTLGYIGTNGVTMLPQTQSLMVTPFSHANTQFKNVPSTFQVGYINDFGGLSFYEINCPVVNNICNISVAKRDQ

SEQ ID NO: 15336 - protein, 740 aa, Escherichia coli H489
MTPEQLTLLGFTDEFIEKTQQTLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEDDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTVILPCISQN

SEQ ID NO: 15337 - protein, 686 aa, Escherichia coli H489
MFWRDMTLSVWRKKTTDLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 15338 - protein, 360 aa, Escherichia coli H489; identical to SEQ ID NO: 6702

SEQ ID NO: 15339 - protein, 432 aa, Escherichia coli H489; identical to SEQ ID NO: 5727

SEQ ID NO: 15340 - protein, 446 aa, Escherichia coli H489 [sequence omitted]

SEQ ID NO: 15341 - protein, 478 aa, Escherichia coli H489; identical to SEQ ID NO: 5711

SEQ ID NO: 15342 - protein, 368 aa, Escherichia coli H489
MNKTITALTIIMASFAANASVLPETPVPFKSGTGAIDNDTVYIGLGSAGTAWYKLDTQAKDKRWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAYYFDKKAEDYFFNKFLLSFDPSTQQWSYAGESPWYGTAGAAVVNKGDKTWLINGEAKPGLRTDAVFELDFTGDNLKWNKLDPVSSPDGVAGGFAGISNDSLIFAGGAGFKGSRENYQNGKNYAHEGLKKSYSVDIHLWYNGKWDKSGELSQGRAYGVSLPWNNSLLIIGGETAGGKAVMDSVLISVKDNKVTVQN

SEQ ID NO: 15343 - protein, 241 aa, Escherichia coli H489; identical to SEQ ID NO: 6143

SEQ ID NO: 15344 - protein, 878 aa, Escherichia coli H489
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMELNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVIQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLVGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 15345 - protein, 784 aa, Escherichia coli H489; identical to SEQ ID NO: 6283

SEQ ID NO: 15346 - protein, 866 aa, Escherichia coli H489; identical to SEQ ID NO: 7714

SEQ ID NO: 15347 - protein, 246 aa, Escherichia coli H489; identical to SEQ ID NO: 6342

SEQ ID NO: 15348 - protein, 747 aa, Escherichia coli H489; identical to SEQ ID NO: 6511

SEQ ID NO: 15349 - protein, 266 aa, Escherichia coli H489; identical to SEQ ID NO: 5772

SEQ ID NO: 15350 - protein, 161 aa, Escherichia coli H489; identical to SEQ ID NO: 5769

SEQ ID NO: 15351 - protein, 412 aa, Escherichia coli H489; identical to SEQ ID NO: 6495

SEQ ID NO: 15352 - protein, 917 aa, Escherichia coli H489
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAIVAWKGQEGSSTWYVIYNGGIYKNAWWVGAANCPGDAKENDASNPWRYVRAATATEISQYGNPGSCSVKPDNNGGTVTPVDPTPETPVTPTPDNSEPSTPADSGNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMHNYAQYSKIKALREAGGDVMLSIGGANNAPLAASCKNVDDLMQHYYDIVDNLNLKVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQKMCWRYLPVSPHFLSMGYFW

SEQ ID NO: 15353 - protein, 654 aa, Escherichia coli H489; identical to SEQ ID NO: 6425

SEQ ID NO: 15354 - protein, 614 aa, Escherichia coli H489; identical to SEQ ID NO: 6387

SEQ ID NO: 15355 - protein, 208 aa, Escherichia coli H489; identical to SEQ ID NO: 5717

SEQ ID NO: 15356 - protein, 119 aa, Escherichia coli H489; identical to SEQ ID NO: 5985

SEQ ID NO: 15357 - protein, 518 aa, Escherichia coli H494; identical to SEQ ID NO: 6358

SEQ ID NO: 15358 - protein, 200 aa, Escherichia coli H494; identical to SEQ ID NO: 6311

SEQ ID NO: 15359 - protein, 374 aa, Escherichia coli H494; identical to SEQ ID NO: 5608

SEQ ID NO: 15360 - protein, 162 aa, Escherichia coli H494; identical to SEQ ID NO: 5896

SEQ ID NO: 15361 - protein, 828 aa, Escherichia coli H494; identical to SEQ ID NO: 6308

SEQ ID NO: 15362 - protein, 663 aa, Escherichia coli H494; identical to SEQ ID NO: 8669

SEQ ID NO: 15363 - protein, 575 aa, Escherichia coli H494
MTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNREDKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLSDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 15364 - protein, 250 aa, Escherichia coli H494; identical to SEQ ID NO: 6317

SEQ ID NO: 15365 - protein, 274 aa, Escherichia coli H494; identical to SEQ ID NO: 6549

SEQ ID NO: 15366 - protein, 224 aa, Escherichia coli H494; identical to SEQ ID NO: 6435

SEQ ID NO: 15367 - protein, 826 aa, Escherichia coli H494
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTRDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRFGAISVDATKSHSKQDNGDVFDGQSYQIAYNKFVSQTSTRFGLAAWRYSSRDYRTFNDHVWANNKDNYRRDENVVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 15368 - protein, 673 aa, Escherichia coli H494
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQNVQELRAATLGDARTVDMVFGLYRQNTREKLNSAYDMPTMPYLSSSGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 15369 - protein, 395 aa, Escherichia coli H494
MKRKVLAMLVPALLVAGAANAAEVYNKDGNKLDLYGKVAGLHYFSDDAGSDGDMSYARIGFKGETQIADQFTGYGQWEFNIGANGPESDKGNTATRLAFAGLGFGQNGTFDYGRNYGVVYDIEAWTDMLPEFGGDTYAGADNFMNGRANGVATYRNNGFFGQVDGLNFALQYQGNNEDDGLFGQEGSGNGNGRKLAKENGDGFGMSTSYDFDFGLSLGAAYSNSDRTDNQVHKGTHNTRYGDRFDATAGGETAEAWTVGAKYDANNVYLAAMYAETRNMTGYGDADAIANKTQNFEVVAQYQFDFGLRPSIAYLQSKGKDLGGVNSDNFDSQGNHHYTNKDLVKYVDIGMTYYFNKNISTYVDYKINLLDNDDDFYKENGIATDDIVAVGLVYQF

SEQ ID NO: 15370 - protein, 118 aa, Escherichia coli H494 [sequence omitted]

SEQ ID NO: 15371 - protein, 351 aa, Escherichia coli H494; identical to SEQ ID NO: 6367

SEQ ID NO: 15372 - protein, 161 aa, Escherichia coli H494; identical to SEQ ID NO: 5769

SEQ ID NO: 15373 - protein, 266 aa, Escherichia coli H494; identical to SEQ ID NO: 5772

SEQ ID NO: 15374 - protein, 747 aa, Escherichia coli H494; identical to SEQ ID NO: 6343

SEQ ID NO: 15375 - protein, 246 aa, Escherichia coli H494
MFFNIKHTTALCFVTCMAFSSSSIADIVISGTRVIYKSDQKSVNVRLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVTGLNGKASSAKVHFYAINDFGGAIEGNASL

SEQ ID NO: 15376 - protein, 866 aa, Escherichia coli H494
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDETNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMDITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 15377 - protein, 784 aa, Escherichia coli H494; identical to SEQ ID NO: 12980

SEQ ID NO: 15378 - protein, 878 aa, Escherichia coli H494
MSYLNLRLYQRNTQCLHIRKHRLAGFFVRLVVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCIANYQLPPESQQQLLTQLSAECR

SEQ ID NO: 15379 - protein, 241 aa, Escherichia coli H494; identical to SEQ ID NO: 6138

SEQ ID NO: 15380 - protein, 368 aa, Escherichia coli H494
MNKTITALAIMMASFAANASVLPETPVPFKSGTGAIDNDTVYIGLGSAGTAWYKLDTQAKDKKWTALAAFPGGPRDQATSAFIDGNLYVFGGIGKNSKGLTQVFNDVHKYNPKTNSWVKLMSHAPMGMAGHVTFVHNGKAYVTGGVNQNIFNGYFEDLNEAGKDSATIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKYNKVTVQN

SEQ ID NO: 15381 - protein, 478 aa, Escherichia coli H494; identical to SEQ ID NO: 8471

SEQ ID NO: 15382 - protein, 237 aa, Escherichia coli H494
MRKITQAISAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPMKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 15383 - protein, 446 aa, Escherichia coli H494; identical to SEQ ID NO: 6459

SEQ ID NO: 15384 - protein, 700 aa, Escherichia coli H494
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPSDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 15385 - protein, 539 aa, Escherichia coli H494; identical to SEQ ID NO: 6525

SEQ ID NO: 15386 - protein, 207 aa, Escherichia coli H494; identical to SEQ ID NO: 5743

SEQ ID NO: 15387 - protein, 565 aa, Escherichia coli H494
MKSPAPSRPQKMALIPACIFLCFAALSVQAEETPVTPQPPDILLGPLFNDVQNAKLFPDQKTFADAVPNSDPLMILADYRMQQNQSGFDLLHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPHQLNTLRTTSIVPVDLNSLMFKMEKILARASKAAGDNAMANQYETLANARQKGIEKYMWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 15388 - protein, 203 aa, Escherichia coli H494; identical to SEQ ID NO: 6396

SEQ ID NO: 15389 - protein, 213 aa, Escherichia coli H494; identical to SEQ ID NO: 5744

SEQ ID NO: 15390 - protein, 729 aa, Escherichia coli H494; identical to SEQ ID NO: 6500

SEQ ID NO: 15391 - protein, 232 aa, Escherichia coli H494; identical to SEQ ID NO: 5747

SEQ ID NO: 15392 - protein, 191 aa, Escherichia coli H494; identical to SEQ ID NO: 5748

SEQ ID NO: 15393 - protein, 229 aa, Escherichia coli H494
MALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAIRSVFKLFWRPEGLPGDPLEAYQQLRWTWNSQGVQLTNPTPYYINLIQVSVNGKALSNAGVVPPKSQRQTSWCQAIAPCHVAWRAINDYGGLSAKKEQNLS

SEQ ID NO: 15394 - protein, 866 aa, Escherichia coli H494; identical to SEQ ID NO: 6328

SEQ ID NO: 15395 - protein, 233 aa, Escherichia coli H494; identical to SEQ ID NO: 6327

SEQ ID NO: 15396 - protein, 362 aa, Escherichia coli H494; identical to SEQ ID NO: 5809

SEQ ID NO: 15397 - protein, 203 aa, Escherichia coli H494; identical to SEQ ID NO: 6414

SEQ ID NO: 15398 - protein, 816 aa, Escherichia coli H494
MNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNISIPQAWLAWHSENWTPPSTWKEGVAGILMDYNLFASSYRPQDGSSSTNLNAYGTTGINAGAWRLRSDYQLNQTDSDDNHEQSGGISRTYLFRPLPQLGSKLTLGETDFSSNIFDGFSYTGAALASDERMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDGSGISVGMVGEEGHAWLSGVAENQQFTVVWGDSQHCSLHLPEHMEDTANRLILPCH

SEQ ID NO: 15399 - protein, 243 aa, Escherichia coli H494; identical to SEQ ID NO: 6463

SEQ ID NO: 15400 - protein, 760 aa, Escherichia coli H494; identical to SEQ ID NO: 6455

SEQ ID NO: 15401 - protein, 331 aa, Escherichia coli H494; identical to SEQ ID NO: 6456

SEQ ID NO: 15402 - protein, 430 aa, Escherichia coli H494; identical to SEQ ID NO: 5758

SEQ ID NO: 15403 - protein, 432 aa, Escherichia coli H494; identical to SEQ ID NO: 5727

SEQ ID NO: 15404 - protein, 359 aa, Escherichia coli H494; identical to SEQ ID NO: 6332

SEQ ID NO: 15405 - protein, 686 aa, Escherichia coli H494; identical to SEQ ID NO: 6339

SEQ ID NO: 15406 - protein, 834 aa, Escherichia coli H494
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIITFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 15407 - protein, 249 aa, Escherichia coli H494; identical to SEQ ID NO: 6450

SEQ ID NO: 15408 - protein, 231 aa, Escherichia coli H494
MSKRTFAVIITLLCSFCIGQALAGGIVLQRTRVIYDASRKEAALPVANKGAETPYLLQSWVDNIDGTSRAPFIITPPLFRLEAGDDSSLRIIKTADNLPENKESLFYINVRAIPAKKKSDDVNANELTLVFKTRIKMFYRPAHLKGRVNDAWTSLEFKRSDHSLNIYNPTEYYVVFAGLAVDKTDLTSKIEYIAPGEHKQLLLPASGGKNVKWAAINDYGGSSGTETRPLQ

SEQ ID NO: 15409 - protein, 838 aa, Escherichia coli H494
MPQRHHQGHKRTPKQLALIIKRCLPMVLTGSGMLCTTANAEEYYFDPIMLETTKSGMQATELSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 15410 - protein, 678 aa, Escherichia coli H494; identical to SEQ ID NO: 7968

SEQ ID NO: 15411 - protein, 230 aa, Escherichia coli H494; identical to SEQ ID NO: 14528

SEQ ID NO: 15412 - protein, 820 aa, Escherichia coli H494
MKIPTTTDIPQRYTWCLAGICYSSLAILPSFLSYAESYFNPAFLLENGTSVADLSRFERGNHQPARVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYATLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSIGITSMWVMTGKFI

SEQ ID NO: 15413 - protein, 365 aa, Escherichia coli H494; identical to SEQ ID NO: 7931

SEQ ID NO: 15414 - protein, 746 aa, Escherichia coli H494; identical to SEQ ID NO: 6296

SEQ ID NO: 15415 - protein, 193 aa, Escherichia coli H494; identical to SEQ ID NO: 6300

SEQ ID NO: 15416 - protein, 402 aa, Escherichia coli H494
MLIPGVQAAKPQKVTLMVDDVPVAQVLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 15417 - protein, 883 aa, Escherichia coli H494
MTAFRAAFKAYRMHQVLILPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLQDRLADASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 15418 - protein, 236 aa, Escherichia coli H494; identical to SEQ ID NO: 7814

SEQ ID NO: 15419 - protein, 102 aa, Escherichia coli H494; identical to SEQ ID NO: 6285

SEQ ID NO: 15420 - protein, 243 aa, Escherichia coli H494; identical to SEQ ID NO: 6145

SEQ ID NO: 15421 - protein, 725 aa, Escherichia coli H494; identical to SEQ ID NO: 6197

SEQ ID NO: 15422 - protein, 121 aa, Escherichia coli H494; identical to SEQ ID NO: 6175

SEQ ID NO: 15423 - protein, 733 aa, Escherichia coli H494
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAVFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 15424 - protein, 208 aa, Escherichia coli H494; identical to SEQ ID NO: 5717

SEQ ID NO: 15425 - protein, 614 aa, Escherichia coli H494; identical to SEQ ID NO: 6303

SEQ ID NO: 15426 - protein, 121 aa, Escherichia coli H591
MDAVLSVQGASAPVKKKSFFSKFTRLNMLRLVRAVIPAAVLMMFFPQLAMAAGGAGQDLMASGNNTVKATFGKDSSIVKWVVLAEVLVGAVMYMMTKNVKFLAGFAIISVFIAVGMAVVGL

SEQ ID NO: 15427 - protein, 353 aa, Escherichia coli H591
MKMKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGGEDLVNYIDVGATYYFNKNMSAFVDYKINQLDSDNKLNINNDDIVAIGMTYQF

SEQ ID NO: 15428 - protein, 230 aa, Escherichia coli H591; identical to SEQ ID NO: 8315

SEQ ID NO: 15429 - protein, 869 aa, Escherichia coli H591; identical to SEQ ID NO: 8316

SEQ ID NO: 15430 - protein, 823 aa, Escherichia coli H591
MFTVQFFIDCRNILIILLITICICNRVMARRGKRGHLLTNCTACLSGSKVFAVAGCVVLRTTMPDSCNSWQKCRNKTMNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDLTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 15431 - protein, 193 aa, Escherichia coli H591; identical to SEQ ID NO: 6300

SEQ ID NO: 15432 - protein, 245 aa, Escherichia coli H591
MKMTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALRKKAGEKVELQLQVSQQGNQLTLKNPTAYYLTIAYLGRNEKGVLPGFKTVMVAPFSTVNTNTGNYSGSQFYLGYMDDYGALRMTTLNCSGQCHLQAVEAKK

SEQ ID NO: 15433 - protein, 819 aa, Escherichia coli H591; identical to SEQ ID NO: 6642

SEQ ID NO: 15434 - protein, 430 aa, Escherichia coli H591; identical to SEQ ID NO: 5758

SEQ ID NO: 15435 - protein, 360 aa, Escherichia coli H591; identical to SEQ ID NO: 6315

SEQ ID NO: 15436 - protein, 332 aa, Escherichia coli H591; identical to SEQ ID NO: 5757

SEQ ID NO: 15437 - protein, 629 aa, Escherichia coli H591
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVTTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLVNWKAGALYHLTENGNVYINYAVSQQPPGGNNFALAQSGSGNSANRTDFKPQKANTSEIGTKWQVLDKRLLLPPRYSVLISKMKLSKMMTELTRNTVRNVSKAMRYPWPGISLPRGR

SEQ ID NO: 15438 - protein, 204 aa, Escherichia coli H591; identical to SEQ ID NO: 5755

SEQ ID NO: 15439 - protein, 362 aa, Escherichia coli H591; identical to SEQ ID NO: 5809

SEQ ID NO: 15440 - protein, 233 aa, Escherichia coli H591; identical to SEQ ID NO: 6327

SEQ ID NO: 15441 - protein, 866 aa, Escherichia coli H591; identical to SEQ ID NO: 8332

SEQ ID NO: 15442 - protein, 164 aa, Escherichia coli H591
MSTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAIAPCHVAWRAINDYGGLSAKKEQNLP

SEQ ID NO: 15443 - protein, 517 aa, Escherichia coli H591; identical to SEQ ID NO: 6817

SEQ ID NO: 15444 - protein, 191 aa, Escherichia coli H591; identical to SEQ ID NO: 5748

SEQ ID NO: 15445 - protein, 235 aa, Escherichia coli H591; identical to SEQ ID NO: 6404

SEQ ID NO: 15446 - protein, 729 aa, Escherichia coli H591
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTQGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFAHGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 15447 - protein, 213 aa, Escherichia coli H591; identical to SEQ ID NO: 5744

SEQ ID NO: 15448 - protein, 565 aa, Escherichia coli H591; identical to SEQ ID NO: 6492

SEQ ID NO: 15449 - protein, 207 aa, Escherichia coli H591; identical to SEQ ID NO: 5743

SEQ ID NO: 15450 - protein, 551 aa, Escherichia coli H591; identical to SEQ ID NO: 5742

SEQ ID NO: 15451 - protein, 700 aa, Escherichia coli H591; identical to SEQ ID NO: 7945

SEQ ID NO: 15452 - protein, 219 aa, Escherichia coli H591; identical to SEQ ID NO: 6490

SEQ ID NO: 15453 - protein, 274 aa, Escherichia coli H591; identical to SEQ ID NO: 6549

SEQ ID NO: 15454 - protein, 250 aa, Escherichia coli H591; identical to SEQ ID NO: 7896

SEQ ID NO: 15455 - protein, 880 aa, Escherichia coli H591
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLSDGSHPPFGAEVKNDNEQTVGLVDDDGNVYLAGVKPGEHMSVFWSGVAHCDINLPDPLPADLFNGLLLPCQHKGNVAPITSPAVKPAIQEQTQRVTPTEPPTSISVNQ

SEQ ID NO: 15456 - protein, 405 aa, Escherichia coli H591
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKDTKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALNGKNQRES

SEQ ID NO: 15457 - protein, 865 aa, Escherichia coli H591
MPRFARLTIALGLATAVFPVDAEYYFNPRFLSNDLAESVDLSAFTKGREAPPGTYRVDIYLNDEFMTSRDITFIADDNNAELIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYYSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 15458 - protein, 239 aa, Escherichia coli H591; identical to SEQ ID NO: 6291

SEQ ID NO: 15459 - protein, 111 aa, Escherichia coli H591; identical to SEQ ID NO: 8676

SEQ ID NO: 15460 - protein, 122 aa, Escherichia coli H591; identical to SEQ ID NO: 5737

SEQ ID NO: 15461 - protein, 405 aa, Escherichia coli H591
MKIIITREYIMKRKVLAMLVPALLVAGAANAAEVYNKDGNKLDLYGKVVGLHYFSDDSGSDGDMSYARIGFKGETQIADQFTGYGQWEFNIGANGPESDKGNTATRLAFAGLGFGQNGTFDYGRNYGVVYDVEAWTDMLPEFGGDTYAGADNFMNGRANGVATYRNNGFFGQVDGLNFALQYQGNNEDDGLFGQEGSGNGNGRKLAKENGDGFGMSTSYDFDFGLSLGAAYSNSDRTDNQVHKGLHNTRYGDRFDATAGGETAEAWTVGAKYDANNVYLAAMYAETRNMTGYGDADAIANKTQNFEVVAQYQFDFGLRPSIAYLQSKGKDLGGVNSDNFDSQGNHHYTNKDLVKYVDIGMTYYFNKNMSTYVDYKINLLDNDDDFYKENGIATDDIVAVGLVYQF

SEQ ID NO: 15462 - protein, 826 aa, Escherichia coli H591
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRFGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 15463 - protein, 224 aa, Escherichia coli H591; identical to SEQ ID NO: 6435

SEQ ID NO: 15464 - protein, 663 aa, Escherichia coli H591; identical to SEQ ID NO: 8669

SEQ ID NO: 15465 - protein, 828 aa, Escherichia coli H591; identical to SEQ ID NO: 7891

SEQ ID NO: 15466 - protein, 169 aa, Escherichia coli H591; identical to SEQ ID NO: 8240

SEQ ID NO: 15467 - protein, 374 aa, Escherichia coli H591; identical to SEQ ID NO: 5608

SEQ ID NO: 15468 - protein, 432 aa, Escherichia coli H591; identical to SEQ ID NO: 5727

SEQ ID NO: 15469 - protein, 360 aa, Escherichia coli H591; identical to SEQ ID NO: 6645

SEQ ID NO: 15470 - protein, 686 aa, Escherichia coli H591; identical to SEQ ID NO: 6453

SEQ ID NO: 15471 - protein, 837 aa, Escherichia coli H591
MEQMYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 15472 - protein, 252 aa, Escherichia coli H591; identical to SEQ ID NO: 7371

SEQ ID NO: 15473 - protein, 231 aa, Escherichia coli H591; identical to SEQ ID NO: 6351

SEQ ID NO: 15474 - protein, 838 aa, Escherichia coli H591; identical to SEQ ID NO: 6447

SEQ ID NO: 15475 - protein, 678 aa, Escherichia coli H591; identical to SEQ ID NO: 6353

SEQ ID NO: 15476 - protein, 412 aa, Escherichia coli H591; identical to SEQ ID NO: 6284

SEQ ID NO: 15477 - protein, 243 aa, Escherichia coli H591
MSRKSCLIRLFKTTVSCKLFTAIILSVFLGQPALTYAGVVIGGTRVVYLSNNADKSISVFSKEEKIPYLIQAWVDPFNKEDKSKAPFTVIPPVSRLEPAQEKILRIIHTKGVSLPDDRESVFWLNIKNIPPSASNKATNSLEIAVKTRIKLFWRPANIRLIPEDAAPKVKWRREGRNLIAENPNPIHISVMDVIVDGHDVPLNMIRPFETLTLPLPANSAGGQMTWRFINDYGAVSDPIKMTL

SEQ ID NO: 15478 - protein, 628 aa, Escherichia coli H591
MKPAASFFYCGCFTMIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHFGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 15479 - protein, 208 aa, Escherichia coli H591; identical to SEQ ID NO: 5717

SEQ ID NO: 15480 - protein, 446 aa, Escherichia coli H591; identical to SEQ ID NO: 6459

SEQ ID NO: 15481 - protein, 237 aa, Escherichia coli H591; identical to SEQ ID NO: 6533

SEQ ID NO: 15482 - protein, 478 aa, Escherichia coli H591; identical to SEQ ID NO: 5711

SEQ ID NO: 15483 - protein, 397 aa, Escherichia coli H591
MFTTAEIIYRKTVIALVCHLNCSRQETVTMNKTITALAIMMASFAANASVLPETPVPFKSGTGAIDNDTVYIGLGSAGTAWYKLDTQAKDKKWTALAAFPGGPRDQATSAFIDGNLYVFGGIGKNSKGLTQVFNDVHKYNPKTNSWVKLMSHAPMGMAGHVTFVHNGKAYVTGGVNQNIFNGYFEDLNEAGKDSATIDKINAHYFDKKAEDYFFNKFLLSFDPSTQQWSYAGESPWYGTAGAALVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 15484 - protein, 241 aa, Escherichia coli H591; identical to SEQ ID NO: 6134

SEQ ID NO: 15485 - protein, 878 aa, Escherichia coli H591
MSYLNLRLYQRNTQCLHIRKHRLAGFFVRLFVACAFAAQTPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNNHYAYLNLQSGLNIGAWRLRDNTSWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPERQQQLLTQLSAECR

SEQ ID NO: 15486 - protein, 784 aa, Escherichia coli H591; identical to SEQ ID NO: 6283

SEQ ID NO: 15487 - protein, 866 aa, Escherichia coli H591
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARLSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 15488 - protein, 246 aa, Escherichia coli H591; identical to SEQ ID NO: 6342

SEQ ID NO: 15489 - protein, 747 aa, Escherichia coli H591; identical to SEQ ID NO: 6343

SEQ ID NO: 15490 - protein, 266 aa, Escherichia coli H591; identical to SEQ ID NO: 5772

SEQ ID NO: 15491 - protein, 161 aa, Escherichia coli H591; identical to SEQ ID NO: 5769

SEQ ID NO: 15492 - protein, 774 aa, Escherichia coli H736; identical to SEQ ID NO: 7727

SEQ ID NO: 15493 - protein, 784 aa, Escherichia coli H736; identical to SEQ ID NO: 6283

SEQ ID NO: 15494 - protein, 865 aa, Escherichia coli H736; identical to SEQ ID NO: 6375

SEQ ID NO: 15495 - protein, 246 aa, Escherichia coli H736; identical to SEQ ID NO: 6964

SEQ ID NO: 15496 - protein, 747 aa, Escherichia coli H736
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLIGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 15497 - protein, 266 aa, Escherichia coli H736; identical to SEQ ID NO: 5772

SEQ ID NO: 15498 - protein, 161 aa, Escherichia coli H736; identical to SEQ ID NO: 5769

SEQ ID NO: 15499 - protein, 221 aa, Escherichia coli H736; identical to SEQ ID NO: 8014

SEQ ID NO: 15500 - protein, 517 aa, Escherichia coli H736; identical to SEQ ID NO: 6406

SEQ ID NO: 15501 - protein, 191 aa, Escherichia coli H736; identical to SEQ ID NO: 5748

SEQ ID NO: 15502 - protein, 235 aa, Escherichia coli H736; identical to SEQ ID NO: 6404

SEQ ID NO: 15503 - protein, 828 aa, Escherichia coli H736; identical to SEQ ID NO: 6366

SEQ ID NO: 15504 - protein, 169 aa, Escherichia coli H736
MKKESKKMKTILPAVLFAAFATTSAWAAESVQPLEKIAPYPQAEKGMKRQVIQLTPQEDESTLKVELLIGQTLEVDCNLHRLGGKLENKTLEGWGYDYYVFDKVSSPVSTMMACPDGKKEKKFVTAYLGDAGMLRYNSKLPIVVYTPDNVDVKYRVWKAEEKIDNAVVR

SEQ ID NO: 15505 - protein, 367 aa, Escherichia coli H736; identical to SEQ ID NO: 5789

SEQ ID NO: 15506 - protein, 729 aa, Escherichia coli H736; identical to SEQ ID NO: 6402

SEQ ID NO: 15507 - protein, 213 aa, Escherichia coli H736; identical to SEQ ID NO: 5744

SEQ ID NO: 15508 - protein, 565 aa, Escherichia coli H736; identical to SEQ ID NO: 8030

SEQ ID NO: 15509 - protein, 207 aa, Escherichia coli H736; identical to SEQ ID NO: 5743

SEQ ID NO: 15510 - protein, 274 aa, Escherichia coli H736; identical to SEQ ID NO: 6362

SEQ ID NO: 15511 - protein, 250 aa, Escherichia coli H736; identical to SEQ ID NO: 6361

SEQ ID NO: 15512 - protein, 881 aa, Escherichia coli H736; identical to SEQ ID NO: 7317

SEQ ID NO: 15513 - protein, 518 aa, Escherichia coli H736; identical to SEQ ID NO: 6358

SEQ ID NO: 15514 - protein, 353 aa, Escherichia coli H736
MKMKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 15515 - protein, 551 aa, Escherichia coli H736; identical to SEQ ID NO: 6971

SEQ ID NO: 15516 - protein, 434 aa, Escherichia coli H736
MNVIQNNKRIEMNTTLRALSVALAAALIAPSAFAASAAIPTIDFHGYMRAGVGVSSDGSEVEWQKNKLGRLGNESDTYGELELGSEVYKKDDVSFYLDSMVSMVSDGSNDNETTLNDDAQFGLRQLNLQIKGLIPGDPNAVIWGGKRYYQRHDLHIIDTKYWNISGSGAGVENYTLGPGAVSLAWIRGDANDVDYRVDGDSNVNINYIDLRYAGWKPWAGSWTEFGIDYAMPNTTKKQDSYGGLYDADNGVMLTGEISQDMLGGYNKTVLQYANKGLAQNMVSQGGGWYDMWNYVNDATGYRVINTGLIPITEKFSINHVLTWGSADDITDYTDKTRMLSLVARGQYQFTDYVRLIGEVGGFYQKDSYNNGTSYKQAGEKYTIALGLADGPDFMSRPELRIFASYLNDSEDGKPFEDQTANNTWNFGVQVEAWW

SEQ ID NO: 15517 - protein, 700 aa, Escherichia coli H736; identical to SEQ ID NO: 6388

SEQ ID NO: 15518 - protein, 111 aa, Escherichia coli H736; identical to SEQ ID NO: 8122

SEQ ID NO: 15519 - protein, 230 aa, Escherichia coli H736; identical to SEQ ID NO: 6360

SEQ ID NO: 15520 - protein, 869 aa, Escherichia coli H736; identical to SEQ ID NO: 12649

SEQ ID NO: 15521 - protein, 766 aa, Escherichia coli H736
MLMTTMPDSCNSWQKCRNKTMNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 15522 - protein, 193 aa, Escherichia coli H736; identical to SEQ ID NO: 6300

SEQ ID NO: 15523 - protein, 242 aa, Escherichia coli H736; identical to SEQ ID NO: 6420

SEQ ID NO: 15524 - protein, 818 aa, Escherichia coli H736; identical to SEQ ID NO: 6419

SEQ ID NO: 15525 - protein, 122 aa, Escherichia coli H736; identical to SEQ ID NO: 5737

SEQ ID NO: 15526 - protein, 430 aa, Escherichia coli H736; identical to SEQ ID NO: 5758

SEQ ID NO: 15527 - protein, 360 aa, Escherichia coli H736; identical to SEQ ID NO: 6315

SEQ ID NO: 15528 - protein, 332 aa, Escherichia coli H736; identical to SEQ ID NO: 5757

SEQ ID NO: 15529 - protein, 760 aa, Escherichia coli H736; identical to SEQ ID NO: 6415

SEQ ID NO: 15530 - protein, 417 aa, Escherichia coli H736
MLFWITALIDIFMKIIITREYIMKRKVLAMLVPALLVAGAANAAEVYNKDGNKLDLYGKVAGLHYFSDDAGSDGDMSYARIGFKGETQIADQFTGYGQWEFNIGANGPESDKGNTATRLAFAGLGFGQNGTFDYGRNYGVVYDIEAWTDMLPEFGGDTYAGADNFMNGRANSVATYRNNGFFGQVDGLNFALQYQGNNEKSGLFDQEGSGNGNGRKLAKENGDGYGMSTSYDFDFGLSLGAAYSNSDRTDNQVHKGLHNTRYGDRFDATAGGETAEAWTVGAKYDANNVYLAAMYAETRNMTGYGDADAIANKTQNFEVVAQYQFDFGLRPSIAYLQSKGKDLGGLNGDNFDSQGNHHYANKDLVKYVEVGATYYFNKNMSTYVDYKINLLDNDDDFYKENGIATDDIVAVGLVYQF

SEQ ID NO: 15531 - protein, 204 aa, Escherichia coli H736; identical to SEQ ID NO: 5755

SEQ ID NO: 15532 - protein, 362 aa, Escherichia coli H736; identical to SEQ ID NO: 5809

SEQ ID NO: 15533 - protein, 233 aa, Escherichia coli H736; identical to SEQ ID NO: 6411

SEQ ID NO: 15534 - protein, 866 aa, Escherichia coli H736
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYAISYRENRIALDAASLKRNVDLENAVVNVVPTKGALVLAEFNAHAGARVLMKTSKQGIPLRFGAIATLDGVQANSGIIDDDGSLYMAGLPAKGTISVRWGEAPDQICHINYELTEQQINSAITRMDAICR

SEQ ID NO: 15535 - protein, 245 aa, Escherichia coli H736; identical to SEQ ID NO: 8138

SEQ ID NO: 15536 - protein, 826 aa, Escherichia coli H736
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYSWDIGVFRLDFSVPQAWVEELESGYVPPENWERGINAFYTSYYVSQYYSDYKASGNNKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYLSRDYRTFNDHVWANNKDNYRRDKNDIYDIADYYQNDFGRKNSFSANMSQSLPEGWGSVSLSTLWRDYWGRSGSSKDYQLSYSNNWRRISYTLAASQAYDENHHEEKRFNIFISIPFDWGDDVTTPRRQIYMSNSTTFDDQGVASNNTGLSGTVGSRDQFNYGVNLSYQHQENETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 15537 - protein, 235 aa, Escherichia coli H736
MAASINIRGIKMKGLLSLLISSMIFPVHAGMVIFGTRIIYPAEQKEVMVQLMNQGNRSSLMQAWIDDGDTSLPPEKIQVPFMLTPPVVKVAANSGQQIKIKIMPNKLPSNKESIFYLNVLDIPPNSPEQEGKNALKFAMQNRIKLFYRPAGIAPVNKATFKKLLINRSGNGLVIKNDSANWVTISDVKANNVKVNYETIMIAPLESQSVNVKSNNANNWYLTIIDDHGNYISDKI

SEQ ID NO: 15538 - protein, 663 aa, Escherichia coli H736; identical to SEQ ID NO: 6307

SEQ ID NO: 15539 - protein, 120 aa, Escherichia coli H736
MNTVLSVQGASAPVEKKSFFSKFTRLNMLRLVRAVIPVAVLMMLFPELAMAAGKGTDLMAKGQETVKATFGKDSSIVKWVVLAEVLVGAVMYMMTKNVKFLVGFAILSVFIAVGMSVAGF

SEQ ID NO: 15540 - protein, 837 aa, Escherichia coli H736; identical to SEQ ID NO: 14360

SEQ ID NO: 15541 - protein, 252 aa, Escherichia coli H736
MKLMRYLNTKNIIAAGVLLSCMSSIAWGAIIPDRTRIIMNESDKGEALKLTNQSKNLPYLAQTWIEDTKGNKSRDFIVTVPPMVRLNPSEQIQIRMITQEKIAQLPKDRETLFYFNVREIPPKTDKKNVMQVTMQHALKLFWRPKAIELEDDGVMTYEKVEIIRRNDGSIRFNNKMPYHVTLGYIGTNGVTMLPQTQSLMVTPFSYANTQFKNVPSTFQVGYINDFGGLSFYEINCPVVNNICNISVANRDQ

SEQ ID NO: 15542 - protein, 231 aa, Escherichia coli H736; identical to SEQ ID NO: 6400

SEQ ID NO: 15543 - protein, 863 aa, Escherichia coli H736
MIMAAVPGQKLVHCNKKYKNTGHQGMPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQQLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVSAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGSVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 15544 - protein, 678 aa, Escherichia coli H736; identical to SEQ ID NO: 6398

SEQ ID NO: 15545 - protein, 793 aa, Escherichia coli H736; identical to SEQ ID NO: 6397

SEQ ID NO: 15546 - protein, 432 aa, Escherichia coli H736; identical to SEQ ID NO: 5727

SEQ ID NO: 15547 - protein, 360 aa, Escherichia coli H736; identical to SEQ ID NO: 6702

SEQ ID NO: 15548 - protein, 654 aa, Escherichia coli H736; identical to SEQ ID NO: 6425

SEQ ID NO: 15549 - protein, 897 aa, Escherichia coli H736
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKSNDASNPWRYVRAATATEISETSNPQSCTSAPQPSPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGGAVTPVDPTPETPVTPTPDNSEPSTPADSVNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDINPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLKVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 15550 - protein, 412 aa, Escherichia coli H736; identical to SEQ ID NO: 6390

SEQ ID NO: 15551 - protein, 208 aa, Escherichia coli H736; identical to SEQ ID NO: 5717

SEQ ID NO: 15552 - protein, 628 aa, Escherichia coli H736
MKPAASFFYCGCFTMIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 15553 - protein, 446 aa, Escherichia coli H736 [sequence omitted]

SEQ ID NO: 15554 - protein, 237 aa, Escherichia coli H736; identical to SEQ ID NO: 6384

SEQ ID NO: 15555 - protein, 478 aa, Escherichia coli H736; identical to SEQ ID NO: 5711

SEQ ID NO: 15556 - protein, 232 aa, Escherichia coli LT-68; identical to SEQ ID NO: 5747

SEQ ID NO: 15557 - protein, 729 aa, Escherichia coli LT-68
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGIYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNARDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 15558 - protein, 213 aa, Escherichia coli LT-68; identical to SEQ ID NO: 5744

SEQ ID NO: 15559 - protein, 260 aa, Escherichia coli LT-68; identical to SEQ ID NO: 8177

SEQ ID NO: 15560 - protein, 728 aa, Escherichia coli LT-68
MTPQDSDELCLTEAWLAKAGIYVSADYFREGYDATRQCYVLTKAPSVKVDFDVSTQSLALSIPQKGLVKMPENVDWDYGTGAFRVNYNANANIGRNNTSTFGSADLKANIGHWVVNSSASASGGDSGDNSATINAFTATRAIRALSADLTVGKTSTGSSLLGSTGTYGVSLSRNNSMKPGNLGYTPVFSGIANGASRVTLTQNGRLLHSEMVPAGPFSITDVPLYTSGDVTMKITGEDGREQTQLFPLSVMAGQLNPGQHEFSVAVGLSDDDSDLKGGVFAASYGYGLDGLTLRTGGVFNRDWQGISAGAVLGLSYLGAVSADGAYAMAEYRDGSRSGNKVQLSWSKQLEMTNTGLRVSWSRQSEEYEDMSSFDPTELWSQSNHGRRPKDEWNAGISQSVGGLFSLSVSGWQRSYYPAQMTGRYRYSDDNGLDTGITGTLSTQIKGVSLNLGWSGSRNSQGENNRSASASISVPFTLFERRYSSSTSVSTSKGGGTGFSTGVSGSLNDRFSYSLGGGRDSGGGVSSYLNASYSGDRAYLNGALNHSQSGGTSGSVSVSGSVLVVPMAKDIMFSRTTGDTVAVVNVKDTPGVKVTSGDGQTDSDGNLVVPLNSYDWNTVTIDAGTLPLSTELTNTSQKVVPTDKAVVWMPFDALKVKRYLLQVKQRDGEFVPGGTWARDSKNTPLGFVANNGVLMINTVDAPGDITLGQCRIPAARLQDTEKLQEITCE

SEQ ID NO: 15561 - protein, 191 aa, Escherichia coli LT-68; identical to SEQ ID NO: 5748

SEQ ID NO: 15562 - protein, 511 aa, Escherichia coli LT-68; identical to SEQ ID NO: 6694

SEQ ID NO: 15563 - protein, 138 aa, Escherichia coli LT-68
MLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAIAPCHVAWRAINDYGGLSAKKEQNLP

SEQ ID NO: 15564 - protein, 521 aa, Escherichia coli LT-68
MPSFIGGLVVFVSAAFNAQAETWFDPAFFKDDPSMVADLSRFEKGQKITPGGYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQT

SEQ ID NO: 15565 - protein, 224 aa, Escherichia coli LT-68; identical to SEQ ID NO: 7869

SEQ ID NO: 15566 - protein, 361 aa, Escherichia coli LT-68; identical to SEQ ID NO: 7868

SEQ ID NO: 15567 - protein, 118 aa, Escherichia coli LT-68 [sequence omitted]

SEQ ID NO: 15568 - protein, 387 aa, Escherichia coli LT-68; identical to SEQ ID NO: 7356

SEQ ID NO: 15569 - protein, 446 aa, Escherichia coli LT-68; identical to SEQ ID NO: 6459

SEQ ID NO: 15570 - protein, 614 aa, Escherichia coli LT-68; identical to SEQ ID NO: 6387

SEQ ID NO: 15571 - protein, 208 aa, Escherichia coli LT-68; identical to SEQ ID NO: 5717

SEQ ID NO: 15572 - protein, 386 aa, Escherichia coli LT-68
MVDDVPVAQVLQALAEQEKLNLVVSPDVSGTVSLHLTDVPWKQALQTVVKSAGLITRQEGNILSVHSIAWQNNNIARQEAEQARAQANLPLENCSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 15573 - protein, 132 aa, Escherichia coli LT-68
MSLPDDRESVFWLNIKNIPPSASNKATNSLEIAVKTRIKLFWRPANIRLIPEDAAPKVKWRREGRNLIAENPNPIHISVMDVIVDGHDVPLNMIRPFETLTLPLPANSAGGQMTWRFINDYGAVSDPIKMTL

SEQ ID NO: 15574 - protein, 678 aa, Escherichia coli LT-68
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKKQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTADGVASPAQASVSDLTGDQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGAMLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 15575 - protein, 721 aa, Escherichia coli LT-68
MDEIPALAEKDDDSVINSLEQIIPGTAAEFDFNHQRLNLSIPQIALYRNARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSSDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDENNDRALSLNLSIPLERWLPHSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVIPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 15576 - protein, 114 aa, Escherichia coli LT-68
MCSFCIGQALAGGIVLQRTRVIYDASRKEAALPVANKGAETPYLLQSWVDNIDGTSRAPFIITPPLFRLEAGDDSSLRIIKTADNLPENKESLFYINVRAIPAKKNQMMLMLTS

SEQ ID NO: 15577 - protein, 107 aa, Escherichia coli LT-68; identical to SEQ ID NO: 9122

SEQ ID NO: 15578 - protein, 465 aa, Escherichia coli LT-68
MQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNS

SEQ ID NO: 15579 - protein, 613 aa, Escherichia coli LT-68
MFWRDITLSIWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKT

SEQ ID NO: 15580 - protein, 359 aa, Escherichia coli LT-68; identical to SEQ ID NO: 6332

SEQ ID NO: 15581 - protein, 430 aa, Escherichia coli LT-68
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKG

SEQ ID NO: 15582 - protein, 539 aa, Escherichia coli LT-68; identical to SEQ ID NO: 6525

SEQ ID NO: 15583 - protein, 823 aa, Escherichia coli LT-68
MTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYSWDIGVFRLDFSVPQAWVEELESGYVPPENWERGINAFYTSYYVSQYYSDYKASGNNKSTYVRFNSGLNLLEWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSNYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNWRRISYTLAASQAYDENHHEEKRFNIFISIPFDWGDDVTTPRRQIYMSNSTTFDDQGFASNNTGLSGTVGSRDQFNYGGNLSYQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 15584 - protein, 154 aa, Escherichia coli LT-68
MLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNIKSNNANNWYLTIIDDHGNYISDKI

SEQ ID NO: 15585 - protein, 207 aa, Escherichia coli LT-68; identical to SEQ ID NO: 5743

SEQ ID NO: 15586 - protein, 203 aa, Escherichia coli LT-68; identical to SEQ ID NO: 6347

SEQ ID NO: 15587 - protein, 660 aa, Escherichia coli LT-68
MGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGAAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLMNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 15588 - protein, 828 aa, Escherichia coli LT-68
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGQYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 15589 - protein, 162 aa, Escherichia coli LT-68; identical to SEQ ID NO: 14139

SEQ ID NO: 15590 - protein, 371 aa, Escherichia coli LT-68
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGNPSGEGFTSGVTNNGRDALRQNGDGVGGSITYDYEGFGIGGAISSSKRTDAQNTAAYIGNGDRAETYTGGLKYDANNIYLAAQYTQTYNATRVGSLGWANKAQNFEAVAQYQFDFGLRPSVAYLQSKGKNLGTIAGRNYDDEDILKYVDVGATYYFNKNMSTYVDYKINLLDDNQFTRDAGINTDNIVALGLVYQF

SEQ ID NO: 15591 - protein, 200 aa, Escherichia coli LT-68; identical to SEQ ID NO: 6311

SEQ ID NO: 15592 - protein, 631 aa, Escherichia coli LT-68
MVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 15593 - protein, 774 aa, Escherichia coli LT-68
MTPLRVFRKTTPLVNAIRLSLLPLAGLSFSAFATQVNIAPGSLDKALNQYAAHSGITLSVDASLTRGKQSNGLHGDYDVESGLQQLLDGSGLQVKPLGNNSWTLEPAPAPKEDALTVFGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 15594 - protein, 368 aa, Escherichia coli LT-68
MNKTITALAILMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLVSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 15595 - protein, 216 aa, Escherichia coli LT-68; identical to SEQ ID NO: 8786

SEQ ID NO: 15596 - protein, 388 aa, Escherichia coli LT-68
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPLRNPQKTRQA

SEQ ID NO: 15597 - protein, 237 aa, Escherichia coli LT-68; identical to SEQ ID NO: 6384

SEQ ID NO: 15598 - protein, 784 aa, Escherichia coli LT-68; identical to SEQ ID NO: 6283

SEQ ID NO: 15599 - protein, 170 aa, Escherichia coli LT-68
MSGILTRWRQFGKRYFWPHLLLGMVAASLGLPALSNAAEPNVPAKATTRNHEPSAKVNFGQLALLEANTRRPNSNYSVDYWHQHAIRTVIRHLSFAMAPQTLPVAEESLPLQAQHLALLDTLSALLTQEGTPSEKGYRIDYAHFTPQAKFSTPVWISQAQGIRAGPQRLT

SEQ ID NO: 15600 - protein, 765 aa, Escherichia coli LT-68
MQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVSPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 15601 - protein, 230 aa, Escherichia coli LT-68
MAFSSSSIADIVISGTRVIYKSDQKSVNVRLENKGNNPLLVQSWLDTGDDNAEPSSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVTGLNGKASSAKVHFYAINDFGGAIEGNASL

SEQ ID NO: 15602 - protein, 221 aa, Escherichia coli LT-68
MKNYLWLVAQLPLLSGCESQAILVKKDDAYFAPPKTEAPPPADGRAGGVFETGYNWSLTADRRAYRVGDILTVILEESTQSSKQAKTNFGKSNTVDIGAPTIFGHTKDKLSGSIDANRDFDGSATSQQQNSLRREITVSVHAVQPNGILEIRGEKWLTLNQGDEYIRLSGLVRADDIQNDNSVSSQRIADARISYAGRGALSDANAAGWLTRLFNHPLFPI

SEQ ID NO: 15603 - protein, 351 aa, Escherichia coli LT-68
MKKSTLALVVMGIVASASVQAAGIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 15604 - protein, 747 aa, Escherichia coli LT-68
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGAFNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 15605 - protein, 266 aa, Escherichia coli LT-68
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRLPWPQVSREQVLARSPQAIVITGGPDQIPKIKQYWGEQLKIPVIPLTSDWFERASPRIILAAQQLCNALSQVD

SEQ ID NO: 15606 - protein, 161 aa, Escherichia coli LT-68
MKKWLLAAGLGLALATSAQAADKIAIVNMGSLFQQVAQKTGVSNMLENEFKGRASELQRMETDLQAKMKKLQSMKAGSDRTKLEKDVMAQRQTFAQKAQAFEQDRARRSNEERGKLVTRIQTAVKSVANSQDIDLVVDANAVAYNSSDVKDITADVLKQVK

SEQ ID NO: 15607 - protein, 222 aa, Escherichia coli LT-68
MLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 15608 - protein, 593 aa, Escherichia coli LT-68
MYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVKWGDGANSRCIAHYVLPKQSLQQAVTVISAVCTHPGS

SEQ ID NO: 15609 - protein, 68 aa, Escherichia coli LT-68
MGLSATWDVTKNVSLTGGVDNLFDKRLWRAGNAQTTGDLAGANYIAGAGAYTYNEPGRTWYMSVNTHF

SEQ ID NO: 15610 - protein, 680 aa, Escherichia coli LT-68
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKNTTTKVSQRLARKPKKSVLTALWV

SEQ ID NO: 15611 - protein, 193 aa, Escherichia coli LT-68; identical to SEQ ID NO: 6300

SEQ ID NO: 15612 - protein, 645 aa, Escherichia coli LT-68
MLTRVKYPTLASICLTESHTALRSDYQLNQTDSDDNHEQSGGISRTYLFRPLPQLGSKLTLGETDFSSNIFDGFSYTGAALASDERMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDHDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 15613 - protein, 430 aa, Escherichia coli LT-68
MKQALRVAFGFLILWASALHAEVRIVIDSGVDSGRPIGVVPFQWAGPGAAPEDIGGIVAADLRNSGKFNPLDRARLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKFPAWSPYL

SEQ ID NO: 15614 - protein, 518 aa, Escherichia coli LT-68; identical to SEQ ID NO: 6358

SEQ ID NO: 15615 - protein, 408 aa, Escherichia coli LT-68
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTWPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQLQEYDISTASMPYLTRPGQVRYKIMMGRPQEWGHHVEGEFFLVLKLPGGSLTAGRYMAAH

SEQ ID NO: 15616 - protein, 250 aa, Escherichia coli LT-68; identical to SEQ ID NO: 6317

SEQ ID NO: 15617 - protein, 274 aa, Escherichia coli LT-68; identical to SEQ ID NO: 8357

SEQ ID NO: 15618 - protein, 646 aa, Escherichia coli LT-68
MRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEAHYMGDIMADDENTAKAPSYTLVGLFTGYKYKYHNLTVDLFGRVDNLFDKEYVGSVIVNESNGRYYEPSPGRNYGVGMNIAWRFE

SEQ ID NO: 15619 - protein, 295 aa, Escherichia coli LT-68
MQTTRTPYSISFMATVLLLLLFACHSTVANAAVALGATRVISSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTLRLR

SEQ ID NO: 15620 - protein, 102 aa, Escherichia coli LT-68; identical to SEQ ID NO: 6285

SEQ ID NO: 15621 - protein, 203 aa, Escherichia coli LT-68; identical to SEQ ID NO: 6414

SEQ ID NO: 15622 - protein, 866 aa, Escherichia coli M605
MTIKPTKNYHNHLTRIATFCALLYCNGAFCAELVEYDHTFLMGQNASNIDLSRYSEGNPAIPGVYDVSVYVNDQPVINQSITFVAIEGKKNARACITLKNLLQFHINSPDINSEKAVLLARDEALGNCLNLTEIIPQASVRYDVNDQRLDIDVPQAWVMKNYQNYVDPSLWENGINAAMLSYNLNGYHSETPGRKNDSIYAAFNGGMNLGAWRLRASGNYNWMTDSGGNYDFKNRYIQRDIASLRSQFIIGESYTTGETFDSVSIRGIRLYSDSRMLPPTLASFAPIIHGVANTNAKVTITQGGYKIYETTVPPGAFVIDDLSPSGYGSDLIVTIEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSISAQRSWNEDGDADDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDDQGNVIGNVGQGGQAFVRGIEQQGNINIKWLEESKPVSCLAHYQQSSEAEKIAQSIILNGIRCQIQ

SEQ ID NO: 15623 - protein, 246 aa, Escherichia coli M605; identical to SEQ ID NO: 8292

SEQ ID NO: 15624 - protein, 238 aa, Escherichia coli M605
MSVFSRVCLGFTFLLTASQVQASIVLGGIRIIYPSNQNEVQITLKNKDAYARYLVQSWVSNIDGSKAPFLITPPVYKLEENRQTLLHIVFTGDKNKLPQDRESLFLANIKSVSAMPEELKDKNTLQFAMKARLKLFWRPASLDNSDALTAWEKLKFHKEAGKLIVKNPTPFYISFSDLTVSGKNIVPTESKSEPGALLMMVGPFSEQRFSLPVGAGSIVEWSVITDYGSSSGKRQQKL

SEQ ID NO: 15625 - protein, 749 aa, Escherichia coli M605; identical to SEQ ID NO: 8294

SEQ ID NO: 15626 - protein, 266 aa, Escherichia coli M605; identical to SEQ ID NO: 8295

SEQ ID NO: 15627 - protein, 161 aa, Escherichia coli M605; identical to SEQ ID NO: 5769

SEQ ID NO: 15628 - protein, 784 aa, Escherichia coli M605; identical to SEQ ID NO: 8272

SEQ ID NO: 15629 - protein, 353 aa, Escherichia coli M605; identical to SEQ ID NO: 6846

SEQ ID NO: 15630 - protein, 740 aa, Escherichia coli M605
MADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGSMTNLSGVYGTLLLDNNLNYSVQVGNTQGGNTSSGTSGYSSLNYRGAYGNTNVGYSRSGDSSQIYYGMSGGIIAHADGITFGQPLGDTMVLVKAPGADNVKIENQIGIHTDWRGYAILPFATEYRENRVALNANSLADNVELDETVVTVIPTHGAIARATFNAQIGGKVLMTLKYGNKSIPFGAIVTHGENKNGSIVAENGQVYLTGLQQSGKLQVSWGNDKNSNCIVDYKLPAVSPGTLLNQQTAICR

SEQ ID NO: 15631 - protein, 239 aa, Escherichia coli M605
MHQMQTTRTPYSVSFMATVLLLFLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTHLAMAPEEAPAMLRFRRSGSILTLINPTPYFITVTNMKAGNSNLPNTMVPPKGEVSVDIPHAVTGDISFQTINDYGALTPRIKATMQ

SEQ ID NO: 15632 - protein, 332 aa, Escherichia coli M605; identical to SEQ ID NO: 5757

SEQ ID NO: 15633 - protein, 760 aa, Escherichia coli M605; identical to SEQ ID NO: 8286

SEQ ID NO: 15634 - protein, 766 aa, Escherichia coli M605
MLMTTMPDSCNSWQKCRNKTMNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGKNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 15635 - protein, 193 aa, Escherichia coli M605; identical to SEQ ID NO: 6300

SEQ ID NO: 15636 - protein, 517 aa, Escherichia coli M605
MKHKLQMMKMRWLSAAVMLTLYTSSSWAFSIDDVAKQAQSLAGKGYEAPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDKLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 15637 - protein, 191 aa, Escherichia coli M605; identical to SEQ ID NO: 8302

SEQ ID NO: 15638 - protein, 235 aa, Escherichia coli M605
MIAMQKNAAHTYAISSLLALSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 15639 - protein, 729 aa, Escherichia coli M605; identical to SEQ ID NO: 8306

SEQ ID NO: 15640 - protein, 204 aa, Escherichia coli M605
MMKKIAITCALLSSLVASSVWADAASDLKSRLDKVSSFQASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDAAKFTFTPPQGVTVDDQRK

SEQ ID NO: 15641 - protein, 362 aa, Escherichia coli M605; identical to SEQ ID NO: 8301

SEQ ID NO: 15642 - protein, 213 aa, Escherichia coli M605; identical to SEQ ID NO: 5744

SEQ ID NO: 15643 - protein, 229 aa, Escherichia coli M605
MANGNASIKGYNCNVSQGLVIIMPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 15644 - protein, 430 aa, Escherichia coli M605; identical to SEQ ID NO: 5758

SEQ ID NO: 15645 - protein, 656 aa, Escherichia coli M605; identical to SEQ ID NO: 8311

SEQ ID NO: 15646 - protein, 565 aa, Escherichia coli M605; identical to SEQ ID NO: 8312

SEQ ID NO: 15647 - protein, 551 aa, Escherichia coli M605; identical to SEQ ID NO: 5885

SEQ ID NO: 15648 - protein, 700 aa, Escherichia coli M605; identical to SEQ ID NO: 8282

SEQ ID NO: 15649 - protein, 111 aa, Escherichia coli M605; identical to SEQ ID NO: 5889

SEQ ID NO: 15650 - protein, 121 aa, Escherichia coli M605
MDAVLSVQGASAPIKKKSFFSKFTRLNMLRLARAVIPAAVLMMFFPQLAMAAGSSGQDLMASGNTTVKATFGKDSSIVKWVILAEVLVGAVMYMMTKNVKFLAGFAIISVFIAVGMAVVGL

SEQ ID NO: 15651 - protein, 826 aa, Escherichia coli M605
MLRMTPLASAIVALLIGIEAYAAEETFDTHFMIGGMKDQQVANIRLDDNQPLPGQYDIDIYVNKQWRGKYEIIVKDNPQETCLSREMIKRLGINTDNFASGKQCLTFKQLIQGGSYTWDIGVFRLDFSVPQAWVEELESGYVPPENWERGINAFYTSYYMSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRFGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGFASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICQ

SEQ ID NO: 15652 - protein, 224 aa, Escherichia coli M605; identical to SEQ ID NO: 5893

SEQ ID NO: 15653 - protein, 690 aa, Escherichia coli M605
MLPYARGRKEDVSDTHFIFVVTSWRYGMFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKNVKLRAGVLNLGDKDLSRDDYSYNEDGRRYFMAVDYRF

SEQ ID NO: 15654 - protein, 828 aa, Escherichia coli M605
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAYRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 15655 - protein, 169 aa, Escherichia coli M605; identical to SEQ ID NO: 8240

SEQ ID NO: 15656 - protein, 371 aa, Escherichia coli M605
MKVKVLSLLVPALLVAGAANAAEVYNKDGNKLDLYGKVDGLHYFSDNKSEDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVDGEGMTNNGRGALRQNGDGVGGSITYDYEGFGIGAAVSSSKRTDDQNFGLNGYGERYLGNGDRAETYTGGLKYDANNIYLAAQYTQTYNATRVGSLGWANKAQNFEAVAQYQFDFGLRPSVAYLQSKGKNLGVGRNYDDEDILKYVDVGATYYFNKNMSTYVDYKINLLDDNRFTRDAGINTDDIVALGLVYQF

SEQ ID NO: 15657 - protein, 200 aa, Escherichia coli M605; identical to SEQ ID NO: 8284

SEQ ID NO: 15658 - protein, 274 aa, Escherichia coli M605
MNKTAIALLALLASSASLAATPWQKITQPVPGSAQSIGSFSNGCIIGADTLPIQSEHYQVMRTDQRRYFGHPDLVMFIQRLSRQVSNLGMGTVLIGDMGMPAGGRFNGGHASHQTGLDVDIFLQLPKTRWTSAQLLRPQALDLVSRDGKHVVPTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 15659 - protein, 122 aa, Escherichia coli M605
MEKNMKKRGAFLGLLLVSACASVFAANNETSKSVTFPKCEGLDAAGIAASVKRDYQQNRVARWADDQKIVGQADPVAWVSLQDIQGKDDKWSVPLNVRGKSADIHYQVSVDCKSGMAEYQRR

SEQ ID NO: 15660 - protein, 256 aa, Escherichia coli M605
MIKEQSMFYKLSCSMVVSTTLAVLLTTTNLAAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRKPWQFKVTLTRSGQDYIVNNPTPYHVIISDASTQKKGLTAAGFKPLVMPPKTSQPLKAKMNSAPVLTYINDYGARLPLVFRCEGDTCKVDEAQSLKG

SEQ ID NO: 15661 - protein, 884 aa, Escherichia coli M605
MCMPNHSNFRLRGIACYIALAISGGSVNAWADDSIQFDPRFLELKGDTKIDLGKFSKKGYVDAGKYNLRVFINKQSLSDEYDINWYVSENDPTKTYACLTPELVAALGLKEGIAKSLQWTHNDECLKPGQLDGMEVENDLSQSALLLTVPQAYLEYTSSDWDPPSRWDDGISGLIADYSLNAQTRHQEQGGEDSHDISGNGTVGANLGAWRFRADWQSDYQHTRSNDDEDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADEHYQSAAMGVGRDLAQFGALAFDVTHSHVNLDHDSAHGKGKLDGNSFRVSYAKDFDELNSRVTFAGYRFSEKNFMTMSEYLDASQSDMARTGNDKEMYTITYNQNFAAAGVSVYLNYSHRTYWDRPEQTNYNLMFSHYFNMGSIRNMSISVTGYRYEYDDNTDKGMYLSMSIPWSDSSTVTYNGSYGSGSDSSQVGYFNRIDDATHYQINVGTSEQHGSVDGYLSHDGTLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGINAGEHMMVFWEGSAQCEIVLPKPLPADLFRGLLLPCEQKGTTAPDSLAPEIKPVIQDQTRQVTPSEAPTSISATQ

SEQ ID NO: 15662 - protein, 673 aa, Escherichia coli M605; identical to SEQ ID NO: 6170

SEQ ID NO: 15663 - protein, 715 aa, Escherichia coli M605; identical to SEQ ID NO: 6806

SEQ ID NO: 15664 - protein, 721 aa, Escherichia coli M605; identical to SEQ ID NO: 6807

SEQ ID NO: 15665 - protein, 518 aa, Escherichia coli M605; identical to SEQ ID NO: 8290

SEQ ID NO: 15666 - protein, 360 aa, Escherichia coli M605; identical to SEQ ID NO: 6702

SEQ ID NO: 15667 - protein, 686 aa, Escherichia coli M605
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPNTAQPVLPAQNQALPPEVRAFLNAGRTR

SEQ ID NO: 15668 - protein, 713 aa, Escherichia coli M605; identical to SEQ ID NO: 11059

SEQ ID NO: 15669 - protein, 222 aa, Escherichia coli M605
MSKLGISSLFKTILLTAALAVSFTASAFTEGTDYMVLEKPIPNADKTLIKVFSYACPFCYKYDKAVTGPVSEKVKDIVAFTPFHLETKGEYGKQASEVFAILINKDKAAGISLFDANSQFKKAKFAYYAAYHDKKERWSDGKDPAAFIKTGLDAAGMSQADFEAALKEPAVQETLEKWKASYEVAKIQGVPAYVVNGKYLIYTKSIKSIDAMADLIRELASK

SEQ ID NO: 15670 - protein, 840 aa, Escherichia coli M605; identical to SEQ ID NO: 8262

SEQ ID NO: 15671 - protein, 249 aa, Escherichia coli M605
MNIMKSPLITTGMICLLGICNFAQATVSPDRTRIIFNASNKSATVRLTNQSKIDPYLAQSWIEDASGKKTRDYISTLPPMERIEPDEQVQIRLMALASLNNLPQDRETLFYYNVREIPPRTKEQNVMQIAMQSRLKLFWRPKAIELKEGQMVPLQKVTITRTAAGLTLNNPTPYHITVGYIGTNGKTLMPGADSIMVTPFASATQYLNNLPSTFQLGFVADYGGLEMFKVECNSVQSLCQSSPAKKGKI

SEQ ID NO: 15672 - protein, 678 aa, Escherichia coli M605; identical to SEQ ID NO: 8260

SEQ ID NO: 15673 - protein, 505 aa, Escherichia coli M605; identical to SEQ ID NO: 8268

SEQ ID NO: 15674 - protein, 432 aa, Escherichia coli M605
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTRILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 15675 - protein, 654 aa, Escherichia coli M605; identical to SEQ ID NO: 8265

SEQ ID NO: 15676 - protein, 900 aa, Escherichia coli M605
MKLNIFTKSMIGMGLVCSSLPALAMEAWNNQQGGNKYQVIFDGKIYENAWWVSSTNCPGKAKANDATNPWRLKRTATAAEISQFGNTLSCEKSGSSSSSTSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPGSCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSANSIVDYNDAHYKTSVDQDAWGFVPGGDNPWKKYEPAKAWSASTVYVKGDRVVVDGQAYEALFWTQSDNPALVANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHAQLKGLYGNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 15677 - protein, 412 aa, Escherichia coli M605; identical to SEQ ID NO: 11006

SEQ ID NO: 15678 - protein, 150 aa, Escherichia coli M605
MLPTRKEASLRIMFLGKTNLPTDRETLYWMNVKAIPPTDEKNTQKNTLQLALQNKIKLFYRPENLPVQPGKARNMLRFKYEGKQLKVINPSPYYLTLTGIKVQGSKLPNTFVPPKSDITVSSPVTLAGEITYQTINDFGATTERQKGIMQ

SEQ ID NO: 15679 - protein, 660 aa, Escherichia coli M605; identical to SEQ ID NO: 6837

SEQ ID NO: 15680 - protein, 208 aa, Escherichia coli M605; identical to SEQ ID NO: 5869

SEQ ID NO: 15681 - protein, 628 aa, Escherichia coli M605
MKPAASFFYCGCFTMIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDVWSGFVRGYGYDNRTNYDAFYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGSRYDKDYSSYPYQTVKMGGVSLWDLAVAYPVTSHLTVRGKIANLFDKDYETVYGYQTAGREYTLSGSYTF

SEQ ID NO: 15682 - protein, 446 aa, Escherichia coli M605; identical to SEQ ID NO: 5873

SEQ ID NO: 15683 - protein, 260 aa, Escherichia coli M605; identical to SEQ ID NO: 6790

SEQ ID NO: 15684 - protein, 478 aa, Escherichia coli M605; identical to SEQ ID NO: 6796

SEQ ID NO: 15685 - protein, 234 aa, Escherichia coli M605
MRKKILYTFLLLLSSPVVAHDLEGINLDLTRVIFDSQQNSASIKVNNFNENKSWLLRSWISNYSDDGKSKSFIITPILYRVLPNESIQLKIEKTDDLLPTDRESVFRINVLAIPPKEISNDKTSSKPSDLQFAINSRIKLIYRPHKLNETDKVNAAFKSLKILKKNEYISIENATPYYITMDNVKINNKKVTSIEDFMVAPYSEFKIPTQNAKSFSYTTINDYGGKNPIIDIKF

SEQ ID NO: 15686 - protein, 241 aa, Escherichia coli M605; identical to SEQ ID NO: 6139

SEQ ID NO: 15687 - protein, 878 aa, Escherichia coli M605
MSYLNLRLYQRNTQCLHIRRHRLAGFFVRLFVACAFTAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLADNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 15688 - protein, 381 aa, Escherichia coli M718
MCHLNCSRQETVTMNKTITALAIMMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLITVKDNKVTVQN

SEQ ID NO: 15689 - protein, 241 aa, Escherichia coli M718; identical to SEQ ID NO: 6143

SEQ ID NO: 15690 - protein, 878 aa, Escherichia coli M718; identical to SEQ ID NO: 6669

SEQ ID NO: 15691 - protein, 816 aa, Escherichia coli M718; identical to SEQ ID NO: 14499

SEQ ID NO: 15692 - protein, 227 aa, Escherichia coli M718; identical to SEQ ID NO: 8025

SEQ ID NO: 15693 - protein, 784 aa, Escherichia coli M718; identical to SEQ ID NO: 6283

SEQ ID NO: 15694 - protein, 243 aa, Escherichia coli M718
MLMFPLVKKTVSALFVSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRPSGLQGEPAEAPAKITWKLNNAQLQANNPTPYYVSFNEVKLESGGKTYNVNSSMVAPFSQASFGVTGLPGSVSSGKVVFKAINDFGGNIDGSATF

SEQ ID NO: 15695 - protein, 731 aa, Escherichia coli M718; identical to SEQ ID NO: 14074

SEQ ID NO: 15696 - protein, 266 aa, Escherichia coli M718; identical to SEQ ID NO: 8295

SEQ ID NO: 15697 - protein, 161 aa, Escherichia coli M718; identical to SEQ ID NO: 5769

SEQ ID NO: 15698 - protein, 311 aa, Escherichia coli M718
MHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 15699 - protein, 230 aa, Escherichia coli M718; identical to SEQ ID NO: 6360

SEQ ID NO: 15700 - protein, 869 aa, Escherichia coli M718
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGIGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 15701 - protein, 385 aa, Escherichia coli M718
MNIYRAVTSFFNNSSKKGLTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTQRATGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKALGVSTDDIVAVGLVYQF

SEQ ID NO: 15702 - protein, 766 aa, Escherichia coli M718
MLMTTMPDSCNSWQKCRNKTMNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGITWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 15703 - protein, 193 aa, Escherichia coli M718; identical to SEQ ID NO: 6300

SEQ ID NO: 15704 - protein, 243 aa, Escherichia coli M718; identical to SEQ ID NO: 8524

SEQ ID NO: 15705 - protein, 819 aa, Escherichia coli M718
MDAVNIYRLSVLSCLAMVTPPALAAEFNLNVLDKSIRDSVDISLLNQKGVVAPGDYFVSVTVNNNKISNGQQIRWQKSGDKIIPCINESLIELFGLKSDFRKKLPAIKECVNFSVFPEIIFTFDQANQQLNITIPQAWLAWHSENWTPPSTWNNGIPGFLMDYNLFASTYRPQSGSSSNNLNAYGTTGLNAGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLAAGRPRSSMSHHTEDETFISHEVSWGMLSNTSLYGGMLLAGDDYRSGALGIGQNMLWLGALSFDVTWADSHFDIQQDEQGYSYRFNYSKQVDATNSTISLAAYRFSDRHFHSYANYIDHKYNDADAQDEKQTISLSFGQPITPLNLNLYANILHQSWWNADTSTTANITAGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGAAFHRRSSTNEPRLMVSTDGVGDIPIQGNIDYTNRFGIAVVPFVSSYQPTTVAVNMNDLPDGVTVSENVVKETWTEGAIGFKSLASRAGKDLNVIISDANGHFPPLGADVRQAEGGVSVGMVGENGHAWLSGVDENQQFTVHWGDQKTCAIHLPEHLEDVTKRLILPCH

SEQ ID NO: 15706 - protein, 430 aa, Escherichia coli M718; identical to SEQ ID NO: 5758

SEQ ID NO: 15707 - protein, 332 aa, Escherichia coli M718; identical to SEQ ID NO: 5757

SEQ ID NO: 15708 - protein, 760 aa, Escherichia coli M718
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTATLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 15709 - protein, 204 aa, Escherichia coli M718; identical to SEQ ID NO: 5755

SEQ ID NO: 15710 - protein, 356 aa, Escherichia coli M718
MMKRNILAVIVPALLVAGTANAAEIYNKDGNKVDLYGKAVGLHYFSKGNGENSYGGNGDMTYARLGFKGETQINSDLTGYGQWEYNFQGNNSEGTDAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGKGKKAEQWATGLKYDANNIYLAANYGETRNATPIDGGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 15711 - protein, 233 aa, Escherichia coli M718
MKTCITKGIVTVSLTAILFSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 15712 - protein, 245 aa, Escherichia coli M718
MPARHLYFIMTNTWNRLALLIFAVLSLLVAGELQAGVVVGGTRFIFPADRESKSILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNVGVVPPKSQRQTSWCQAIAPCHVAWRAINDYGGLSAKKEQNLP

SEQ ID NO: 15713 - protein, 229 aa, Escherichia coli M718
MKSVLLLLTVLFVQSVEAGIMPASSRIIYRDGDREKTLMLDNTNDYPVLVQSWVDNGEGSPEAASPPFVVLPPVFRLAARRTQGLRIIYNHDPLPQDRESAFWLNLYEMPPETPHQDPTHLTLAMNTQLKIFYRPKSVTMTPQEAMRKISWHLVNNGSSSYIELNNPTPLNISFTSISIGATKVEQESDMMIKPFSQRRYWLASKNVSGIVTATYLDDNGAQIKQQLTQ

SEQ ID NO: 15714 - protein, 840 aa, Escherichia coli M718
MNKSVVSISAAMLVLLCQPVMGSEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAKELAPGITSQTQLSQLRLDLSVPQSQLISRPRGYVPPSELDTGASLAFMNYIANYYNVAYSGQNAHSQRSLWASFNGGINLGAWQYRQLSNITWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDFTWQHGLTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTTVGLNASKGQDYWQASGNVQGAMAVHGGGVTFGPYLGETFALVEAKGAEGAKVYNSSQLEINDSGYALVPAVTPYRYNRISLDPQGMDGDAELVDSEKQVAPVAGAAVKVVFRTRPGKALLIKSRMADGSELPMGADVLDENNTVVGIAGQGGQIYLRTEQTKGHLSVRWGEGANDSCQLPFDISGKDSNSPIIRLNETCQS

SEQ ID NO: 15715 - protein, 240 aa, Escherichia coli M718
MDMEKIRMNIFAYLLVLVFSMSMSSSAFASVVMTGTRIIFPGDAKEKTIQLRNTSDQPYIINIHVEDERGSDKNVPFMPTPQTFRMEAAAGQALRLLYTGNNLPQDRESVFWFSFSQLPYLNKNDKSQNQLILALTNRVKIFYRPSSIVGKSSDAPKNLTYQVKQNRIEVTNPTGYYVVIRAAELLSNGKKVPLANSVMIAPQSTTEWTLRSGISVARGALIHLVTVNDYGVNVTSEHAL

SEQ ID NO: 15716 - protein, 517 aa, Escherichia coli M718; identical to SEQ ID NO: 6817

SEQ ID NO: 15717 - protein, 191 aa, Escherichia coli M718; identical to SEQ ID NO: 5748

SEQ ID NO: 15718 - protein, 235 aa, Escherichia coli M718; identical to SEQ ID NO: 6404

SEQ ID NO: 15719 - protein, 729 aa, Escherichia coli M718; identical to SEQ ID NO: 5745

SEQ ID NO: 15720 - protein, 213 aa, Escherichia coli M718; identical to SEQ ID NO: 5744

SEQ ID NO: 15721 - protein, 656 aa, Escherichia coli M718
MRLKKHYLCTALSLAFTQQAVAAQESDSLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTRDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFIEEGRNFWAGVEYTF

SEQ ID NO: 15722 - protein, 565 aa, Escherichia coli M718
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPTEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLIESTTQPVKQKEAEPTP

SEQ ID NO: 15723 - protein, 207 aa, Escherichia coli M718
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKNWKVVYGSYDTKTQPAMPANIELTDGGQRIKLKMDNWIVK

SEQ ID NO: 15724 - protein, 725 aa, Escherichia coli M718; identical to SEQ ID NO: 6197

SEQ ID NO: 15725 - protein, 119 aa, Escherichia coli M718; identical to SEQ ID NO: 5675

SEQ ID NO: 15726 - protein, 733 aa, Escherichia coli M718; identical to SEQ ID NO: 5674

SEQ ID NO: 15727 - protein, 551 aa, Escherichia coli M718; identical to SEQ ID NO: 5742

SEQ ID NO: 15728 - protein, 700 aa, Escherichia coli M718; identical to SEQ ID NO: 14045

SEQ ID NO: 15729 - protein, 122 aa, Escherichia coli M718
MEKNMKKRGAFLGLLLVSACASVFAANNGTSKSVTFPKCEGLDAAGIAASVKRDYQQNRVARWADDQKIVGQADPVAWVSLQDIQGKDDKWSVPLTVRGKSADIHYQVSVDCKAGMAEYQRR

SEQ ID NO: 15730 - protein, 273 aa, Escherichia coli M718
MITDVWKYRGKSNTYAGADNFMNGRANSVATYRNNGFFGQVDGLNFALQYQGNNEKSGLFDQEGSGNGNGRKLAKENGDGYGMSTSYDFDFGLSLGAAYSNSDRTDNQVHKGTHNTRYGDRFDATAGGETAEAWTVGAKYDANNVYLAAMYAETRNMTGYGDADAIANKTQNFEVVAQYQFDFGLRPSIAYLQSKGKDLGGVNSDNFDSQGNHHYTNKDLVKYVDIGMTYYFNKNMSTYVDYKINLLDNDDDFYKENGIATDDIVAVGLVYQF

SEQ ID NO: 15731 - protein, 366 aa, Escherichia coli M718; identical to SEQ ID NO: 7946

SEQ ID NO: 15732 - protein, 871 aa, Escherichia coli M718
MHQVLLLPRFVRLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLQDRLVDASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPRFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 15733 - protein, 239 aa, Escherichia coli M718
MHQMQTTRTPYSISFMATVLLLLLFACHSTVANAAVALGATRVNYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 15734 - protein, 111 aa, Escherichia coli M718; identical to SEQ ID NO: 7885

SEQ ID NO: 15735 - protein, 828 aa, Escherichia coli M718; identical to SEQ ID NO: 5735

SEQ ID NO: 15736 - protein, 162 aa, Escherichia coli M718; identical to SEQ ID NO: 5896

SEQ ID NO: 15737 - protein, 370 aa, Escherichia coli M718; identical to SEQ ID NO: 5671

SEQ ID NO: 15738 - protein, 219 aa, Escherichia coli M718
MSLNFTVIVWLRLSIGGVYVLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKDKRDATFKPDYLDGLVMHVEKGKVYLDGEFVNH

SEQ ID NO: 15739 - protein, 274 aa, Escherichia coli M718; identical to SEQ ID NO: 6362

SEQ ID NO: 15740 - protein, 249 aa, Escherichia coli M718
MTNLFSAKTVATTLAFLITATSLQAQASVTPDRTRLIFNESDKSISVTLRNNDPKMPYLAQSWMEDEQGNKISSPLTVLPPVQRIDSMMNGQVKVQGMPDINKLPADRESVFYFNVREIPPKSNKPNTLQIALQTRIKLFWRPKALENVSMKNPWQHKVTLTRSGQEFTVNNPTPYFVVISNASAQKNGNPAAGFSPMVISPKTSVPLKVKMDSVPVLTYVNDYGARMPLYFKCGGDTCQVDVEQSRKG

SEQ ID NO: 15741 - protein, 883 aa, Escherichia coli M718
MDTCMPDHSLFRLRVLPCCIALAMSGSYVNAWAEDEIQFDSRFLELKDDTKIDLKRFSSQGYVEPGKYNLQVQLNKQPLAEEYDIYWYASENDASKTYACLTPELVSQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLALGEDYLNSDIFDGFNYVGGSISTDDQMLPPNLRGYAPDISGVAHTTAKVTVSQMGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDITHSHTRLDKETAYGKGSLDGNSFRVSYSKDFDELNSRVTFAGYRFSEENFMTMSEYLDASDSEMVRTGNDKEMYTATYNQNFRDAGVSVYLNYTRHTYWDRDEQTNYNVMLSHYFNLGSIRNMSISMTGYRYEYDNQADKGVYISLSMPWGDSSTISYNGNYGSGSDSSQVGYFSRVDDATHYQLNVGTSDKHSSVDGYYSHDGSLAQVDLSANYHEGQYTSAGISLQGGATPTAQGGALHRTQNMGGTRLLIDADGVAGVPVEGNGAAVYTNMFGKAVVADVNNYYRNQAYIDLNNLPENAEATQSVVQATLTEGAIGYRKFSVISGQKAMAVLRLQDGSHPPFGAEVKNDNAQNVGLVDDDGNVYLAGVKPGEHMTVSWGGVAHCDIHLPDPLPADLFNGLLLPCQQTGAISPSMPHEIKPVIQEQTQQVMPTEAPVSVSAN

SEQ ID NO: 15742 - protein, 518 aa, Escherichia coli M718
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLPHSPSLLFSRKGSEEKQN

SEQ ID NO: 15743 - protein, 826 aa, Escherichia coli M718
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDLAAGRSHIEGASKQSDFVQAGYQYGFNNLLTLYGGSMVANNYYAFTLGAGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQSLTFGYEVNDIHGHNIGVVGQGSQLFIRTNEVPSSVNVAIDKQQGLSCTITFGKEIDESRNYICQ

SEQ ID NO: 15744 - protein, 224 aa, Escherichia coli M718
MKGLLSLLIFSMVLPAHAGIVIYGTRIIYPAENKEVMVQLMNQGHRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVSRSGNGLVIKNDSANWVTISDVKANNVKVNYETIMIAPLESQSVNVKSNNANNWYLTIIDDHGNYISDKI

SEQ ID NO: 15745 - protein, 466 aa, Escherichia coli M718
MLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 15746 - protein, 656 aa, Escherichia coli M718; identical to SEQ ID NO: 15156

SEQ ID NO: 15747 - protein, 682 aa, Escherichia coli M718; identical to SEQ ID NO: 15155

SEQ ID NO: 15748 - protein, 615 aa, Escherichia coli M718
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKENVT

SEQ ID NO: 15749 - protein, 498 aa, Escherichia coli M718
MKKHLLSCAILLACSPVFAAGNTDSIEARLAALEKRLQDAETRAQKAESRATATEQQVQQLAATPATQPVVPQTVSVPPEKKADNSGFEFHGYARSGLLMNDAASGSKSGPYLTPAGETGGSVGRLGNEGDTYVETVFEHKKTLESGATTRFKVMLADGQKTYNDWSANSSDLNVRQVVAELGNLPDFTGPLKHSTVWAGKRFDRDNFDIHWLDSDVVFLGGTGGGIYDVKWNDTLRSNFSLYGRNFGEMEDIDNNVQNYILTMNHFAGPFQLMVSGMRAKDNDDRRDNNGDLIHASAASHGVHVLAGLHNDSFWGLREGTAKIALLYGHGLGAEVKGIGSDGALRSDADTWRLAAYGTTPLGNGWHIAPSVMAQGSKDRYARGDSYEWVTLNTRLIKEVTQNFALAFEGTYQYMDLKPEGYKDRNAVNGSFYKLTFAPTLKAGGLGDFFSRPELRLFATWMDWSSRLDNYASDDAFGGSGFNAGGEWNFGVQMETWF

SEQ ID NO: 15750 - protein, 231 aa, Escherichia coli M718; identical to SEQ ID NO: 14060

SEQ ID NO: 15751 - protein, 721 aa, Escherichia coli M718
MDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 15752 - protein, 678 aa, Escherichia coli M718
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQVRYWRAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 15753 - protein, 432 aa, Escherichia coli M718; identical to SEQ ID NO: 5727

SEQ ID NO: 15754 - protein, 567 aa, Escherichia coli M718; identical to SEQ ID NO: 14069

SEQ ID NO: 15755 - protein, 360 aa, Escherichia coli M718; identical to SEQ ID NO: 6702

SEQ ID NO: 15756 - protein, 412 aa, Escherichia coli M718
MKQWIAALLLMLIPGVQAAKPQKVTLMVDDVPVAQVLQALAEQEKLNLVVSPDVSGTVSLHLTDVPWKQALQTIVKSAGLITRQEGNILSVHSVAWQNDNIARQEAEQARAQANLPLENRNITLQYADAGELAKAGEKLLSAKGSMTVDKRTNRLLLRDNKTALSALEQWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 15757 - protein, 660 aa, Escherichia coli M718
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASESSNPMVDRSTIQRDVQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYISYQGQQALKGMTTTLVLGNAFDKEYWSPQGIPQDGRNGKIFVSYQW

SEQ ID NO: 15758 - protein, 857 aa, Escherichia coli M718
MSRKTVSRTFSSFSISVVAVAVASTFSAHAGKFNPKFLEDVQGVGQHVDLTMFEKGQEQQLPGIYRVSVYVNEQRMETRTLEFKEATEAQRKAMGESLVPCLSRTQLAEMGVRVESFPALNLVPAEACVPFDEIIPQASSHFDFSEQKLVLSFPQAAMHQVARGTVPESLWDEGIPALLLDYSFSGSNSEYDSTGSSSSYVDDNGTVHHDDGKDTLKSDSYYLNLRSGLNLGAWRLRNYSTWSHSGGKAQWDNIGTSLSRAIIPFKAQLTMGDTATAGDIFDSVQMRGAMLASDEEMLPDSQRGFAPIVRGIAKSNAEVSIEQNGYVIYRTYVQPGAFEINDLYPTANSGDLTVIIKEADGSEQRFIQPFSSVPIFQREGHLKYSFAAGEYQAGNYDSASPRFGQLDLIYGLPWGMTAYGGVLISNNYNAFALGIGKNFGYIGAISIDVTQAKSELNNDRDSQGQSYRFLYSKSFESGTDFRLAGYRYSTSGFYTFQEATDVRSDADSDYNRYHKRSEIQGNLTQQLGAYGSVYLNLTQQDYWNDAGKQNTVSAGYNGRIGKVSYSIAYSWNKSPEWDESDRLWSFNISVPLGRAWSNYRVTTDQDGRTNQQVGVSGTLLEDRNLSYSVQEGYASNGVGNSGNANVGYQGGSGNVNVGYSYGKDYRQLNYSVRGGVIVHSEGVTLSQPLGETMTLISVPGARNARVVNNGGVQVDWMGNAIVPYAMPYRENEISLRSDSLGDDVDVENAFQKVVPTRGAIVRARFDTRVGYRVLMTLLRSAGSPVPFGATATLITDKQNEVSSIVGEEGQLYISGMPEEGRVLIKWGNDASQQCVAPYKLSLELKQGGIVPVSANCQ

SEQ ID NO: 15759 - protein, 232 aa, Escherichia coli M718
MDRMMKSKFVALALSLFLSQSVLAGGVGLSATRVIYDGSKKEASLTVQNKSKTEEFLIQSWVDDAAGSKKTPFIITPPLFRLDPGKNNILRIVNTTPGLPQDRESVYWVNVKAIPSKSDDSENKNVLQIAVRTRIKLFYRPAGLQGDVKTAPNELRFTRSGNQIRVDNPTVFNITFNQFFANDKEIEKAGMVPAKGSLNITLPAGAGSVSKIKYNTINDFGSSAEMMTKNVD

SEQ ID NO: 15760 - protein, 208 aa, Escherichia coli M718
MKKIWLALAGLVLAFSASAAQYEDGKQYTTLEKPVAGAPQVLEFFSFFCPHCYQFEEVLHISDNVKKKLPEGVKMTKYHVNFMGGDLGKDLTQAWAVAMALGVEDKVTVPLFEGIQKTQTIRSASDIRDVFINAGIKGEEYDAAWNSFVVKSLVAQQEKAAADVQLRGVPAMFVNGKYQLNPQGMDTSNMDVFVQQYADTVKYLSEKK

SEQ ID NO: 15761 - protein, 774 aa, Escherichia coli M718
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVHGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNTITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYNDNNKGIYAGQPRTLYMQGSLKF

SEQ ID NO: 15762 - protein, 446 aa, Escherichia coli M718
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYTGNADTNANFGKAVPADFNGGSFGRGDSDEWTFGAQMEIWW

SEQ ID NO: 15763 - protein, 237 aa, Escherichia coli M718
MRKITQAISAVCLLFALNSSAVALASSPSPLNLGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 15764 - protein, 478 aa, Escherichia coli M718
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCTDCHNTASPEFAKGKPESTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 15765 - protein, 111 aa, Escherichia coli M863; identical to SEQ ID NO: 5889

SEQ ID NO: 15766 - protein, 122 aa, Escherichia coli M863; identical to SEQ ID NO: 5737

SEQ ID NO: 15767 - protein, 397 aa, Escherichia coli M863
MKRKVLAMLVPALLVAGAANAAEVYNKDGNKLDFYGKVAGLHYFSDNSGADGDMSYARIGFKGETQIADQFTGYGQWEYNLQANGTEGDGDNSATRLAFAGLGFGQNGTFDYGRNYGVVYDIEAWTDMLPEFGGDTYAGADNFMNGRTNGVATYRNNGFFGQVDGLNFALQYQGNNESGGPFGQEGSGSGDGRSLSKENGDGFGMSTSYDFDFGLSLGAAYSNSDRSDRQVGVGLNDRNHSNRNAGGETAEAWTVGAKYDANNVYLAAMYAETRNMTPYGGGEFDNGESRSAIANKTQNFEVVAQYQFDFGLRPSIAYLQSKGKDLGGWAHDGNGDPRYTNKDLVKYVEVGATYYFNKNMSTYVDYKINLLDNDDDFYEANGIATDDIVAVGLVYQF

SEQ ID NO: 15768 - protein, 826 aa, Escherichia coli M863
MLRMTPLASAIVALLLGIEAYAAEETFDTHFMIGGMKDQQVANIRLDDNQPLPGQYEIDIYVNKQWRGKYEVIVKDNHEETCLEREIIKRLGINTDNFASGKQCLTFEQLVHGGSYTWDIGVFRLDFSVPQAWVEELESGYVPPENWERGINAFYTSYYVSQYYSDYKASGNSKSTYVRFNSGLNLLGWQLHSDASLSKTNSNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVTTPRRQIYMSNSTTFDDQGFASNNTGLSGTVGSRDQFNYGVNLSHQHQGNETTAGANLTWNAPVATVNGSYSQSSTYRQAGASLSGGIVAWSGGVNLANRLSETFAVMNAPGIKDAYVNGQKYRTTNRNGVVVYDGMTPYRENHLMLDVSQSDSEAELRGNRNIAAPFRGAVVLVNFDTDQRKPWFIKALRTDGQPLTFGYEVNDIHGHNIGVVGQGSQLFIRTNEVPPSVNVAIDKQQGLSCTITFGKEIDESRNYICQ

SEQ ID NO: 15769 - protein, 224 aa, Escherichia coli M863
MKGLLALLISSMVLPAHAGIVIYGTRIIYPAENKEVMVQLMNQGNRSSLLQAWIDDGDTSLPPEKIQVPFMLTPPVAKIGANSGQQVKIKIMSNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKTNNANSWHLTIIDDHGNYISDKI

SEQ ID NO: 15770 - protein, 659 aa, Escherichia coli M863
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFVTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSSDLKPETSESWELGLYYMGEEGWLEGVESSVTVFRNDVKDRISISRTSDVNAAPGYQNFVGFTADGVPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 15771 - protein, 828 aa, Escherichia coli M863; identical to SEQ ID NO: 6558

SEQ ID NO: 15772 - protein, 162 aa, Escherichia coli M863; identical to SEQ ID NO: 8101

SEQ ID NO: 15773 - protein, 367 aa, Escherichia coli M863
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGREALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 15774 - protein, 200 aa, Escherichia coli M863
MLAFCRSSLKSKKYFIILLVLAAIAGLGTHAAWSSNGLPRIDNKTLARLAQQHTVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKDKCDATFKPDYLDGLVMHVEKGKVYLDGEFVNH

SEQ ID NO: 15775 - protein, 274 aa, Escherichia coli M863
MNKTAIALLALLASSASLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKKRWTSAQLLRPQALDLVSRDGKHVVPALWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 15776 - protein, 249 aa, Escherichia coli M863
MYTLTRSATRVAPALALLVAASFTTHASVTPDRTRLIFNEGDKSISVTLRNNDPKQPYLAQSWMEDEKGNKISSPLTVLPPVQRIDAMMNGQVKVQGMPDINKLPADRESMFYFNVREIPPKSNKPNTLQIALQTRIKLFWRPKALAKINMRDPWQHKVTLTRNGQAFTVNNPTPYYVIISNASTQKNGNPAAGFTPLVMPPKSSAPLNVKMDTVPVLTYVNDYGARLSLNFKCTGNNCQVDAEQSRKG

SEQ ID NO: 15777 - protein, 878 aa, Escherichia coli M863
MPDHSLFRLRALPWCVAVAISGCHINAWADEDIQFDSRFLELKGDTKIDLKRFSSQGYVEPGKYSLQVEVNKQPLPGEYDIYWYATENDANKTYACLSPDLVALLGFKEDIAKNLQWVHDGKCLKPGQFDGLEMRADLSQSALLISLPQAYLEYSDVDWDPPSRWDDGISGLIADYSINAQTRHEENGGDDSNDISGNGTVGVNLGPWRLRADWQSDYQHTRSNDEETEDSTERNWDWSRYYAWRALPSLKAKLALGEDYLDSDIFDGFNYIGGSISTDDQMLPPNLRGYAPDISGVAHTAAKVTVSQAGRIIYETQVPAGPFRIQDLADFSSGTLHVRIEEVNGQVQEYDISTASMPFLTRPGQVRYKIMMGRPQEWGHHVQGGFFSGGEASWGIANGWSLYGGALGDENYQSAALGIGRDLSVFGAMAFDITHSHTRLDDSTAYGKSTLDGNSFRVSYSKDFDELNSRVTFAGYRFSEENYMTMSEYLDANDSAMVRSGNDKEMYTATYNQNFRDAGVSVYLNYTRHTYWDRDEQTNYNVMLSHYFNMGGIRNMSISLTGYRYEYDDSADKGVYISLSMPWGDSSVVSYNGNYGSGSDSSQVGYFSRIDDASHYQINVGNSENHSSVDGYYSRDGSMAHVDLSANYHEGQYTSAGLSLQGGATLTAHGGALHRTQNMGGTRLLIDADGVADVPVEGNGAAVYTNMFGKAVVADVNNYYRNQATIDLTKLPEDAEATQSVVQATLTEGAIGYRQFAVISGQKAMAVLRMSDGSYPPFGAEVRNEHDQQVGLVDDDGNVYLAGVKAGEHMRVSWNGEPHCEISLPDPLPADLFNGLLLPCKQQGAVMPAAPAEIKPMIQEQTQQVTPGAEPMAISANQ

SEQ ID NO: 15778 - protein, 518 aa, Escherichia coli M863
MKKLKINYLFIGILALLLAVALWPSIPWFGKADNRIAAIQARGELRVSTIHTPLTYNEINGKPFGLDYELAKQFAEYLGVKLKVTVRQNISQLFDDLDNGNADLLAAGLVYNSERVKNYQPGPTYYSVSQQLVYKVGQYRPRTLGNLTAEQLTIAPGHVVVNDLQTLKETKFPELSWKVDDKKGSAELMEDVIEGKLDYTIADSVAISLFQRVHPELAVALDITDEQPVTWFSRLDGDNTLSAALLDFFNEMNEDGTLARIEEKYLGHGDDFDYVDTRTFLRAVDTVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAIQLAQDYPAVSPTELGKEKFPFLSFLSQSSSNYLTHSPSLLFSRKGSEEKQN

SEQ ID NO: 15779 - protein, 746 aa, Escherichia coli M863
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDQFSFRLYGNLDKTQADAWDINQGHQSARAGTYATTLPAGREGVINKDINGVVRWDFAPMQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 15780 - protein, 193 aa, Escherichia coli M863; identical to SEQ ID NO: 6300

SEQ ID NO: 15781 - protein, 243 aa, Escherichia coli M863
MTFMKGLPLLLLVTSLCSHAALQPDRTRIVFNANDKATSLRVDNRSDKLPYLAYSWLENEKGEKSDDLLVALPPIQRLEPKATTQVRIVKQASTAKLPGDRETLFFYNMREIPPAPEKNSDHAVLQVAIQSRIKVFWRPSALRKKAGEKVELQLQVSQQGNQLSLKNPTGYYLTIAYLGRNEQSVLPGFKTVMIAPFSTVSTTTGNYSGSQFYLGYMDDYGALRMTTLNCNGQCRLQAVEAKK

SEQ ID NO: 15782 - protein, 618 aa, Escherichia coli M863
MNQNDGNDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRTSMSHQTENETFFSNEVSWGMLSNTSLYGGLLISGDDYHSAAMGIGQNMLWLGALSFDVTWASSQFDTQQDERGLSYRFNYSKQVDATNSTISLAAYRFSDRHFHSYANYLDHKYNDNDAQDEKQTISLSVGQPITPLNLNLYANLLHQTWWNADASTTANITAGFNVDIGNWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDLSGTYAANDYSSVSSSWSGSFTATQYGAAFHRRSSTNEPRLMVSTDGVADIPVQGNLDYTNHFGIAVVPLVSSYQPSTVAVNMNDLPDGVTVTENVIKETWIEGAIGYKSLASRSGKDINVIIRNASGQFPPLGADIRQDGSSISVGMVGEEGHAWLSGVAENQKFTVVWGDSQRCSIHLPEHMEDTANRLILPCH

SEQ ID NO: 15783 - protein, 430 aa, Escherichia coli M863; identical to SEQ ID NO: 5758

SEQ ID NO: 15784 - protein, 332 aa, Escherichia coli M863; identical to SEQ ID NO: 6321

SEQ ID NO: 15785 - protein, 760 aa, Escherichia coli M863
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDISENTTIRNTTRWSRVKQDYLMTAIMGGASNITQPTSNVDSWTWSRIANTKDVSNKILTNQTNLTSTFYTGSIGHDVSTGVEFTRETQTNYGVNPLTLPAVNIYHPGSSIHPGGLTRNGANANGQTDTFAIYAFDTLQITRDFELNGGIRLDNYHTEYDSATACGGSGRGAVTCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 15786 - protein, 203 aa, Escherichia coli M863; identical to SEQ ID NO: 6414

SEQ ID NO: 15787 - protein, 362 aa, Escherichia coli M863; identical to SEQ ID NO: 5813

SEQ ID NO: 15788 - protein, 224 aa, Escherichia coli M863
MTVSLTAILLSCSSAWAAGKGGIGLAATRLVYSEGEEQISLGVRNTSPDVSYLIQSWVMTPVNKKSADFIITPPLFVLNPANENLLRIMYIGAPLAKDRETLFFTSVRAVPSTTKREEGNTLKIATQSVIKLFWRPKGLAYPLAEAPAKLRCTSSADIVTVSNPTPYFITLTDLKIGGKVVKNQMISPFDKYQFPLPKGAQNSRVTYRTINDYGAETPQLNCKS

SEQ ID NO: 15789 - protein, 851 aa, Escherichia coli M863
MPSFIGGLVVFVSAVFTAQAETWFDPAFFKDDPSMVADLSRFEKGQKITPGVYRVDIVLNQTIVDTRNVNFVEITPEKGIAACLTTENLDAMGMNTDAFPAFKQLDKQACAPLAEIIPDASVTFNVNKLRLEISVPQIAIKSNARGYVPPERWDEGINALLLGYSFSGANSIHSSTDSDSTDSYFLNLNSGVNLGPWRLRNYSTWSRSSGQTAEWKNLSSYLQRAVIPLKGELTVGDDYTAGDFFDSVSFRGVQLASDDNMLPDSLKGFAPLVRGIAKSNAQITIKQNGYTIYQTYVSPGAFEISDLYSTSSSGDLLVEIKESDGSVNSYSVPFSSVPLLQRQGRIKYAVTLAKYRTNSNDQQESKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDMPLWSRYYNLFYTKRGKLQVNISQQLGEYGSFYLSGSQQTYWHTDQQDRLLQFGFNTQIKDLSLGVSWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIVLDAASLKRNVDLENAVVNVVPTKGALVLAEFNAHAGARVLMKTLKQGIPLPFGAIATLDGIQTNSGIIDDDGSLYMSGLPAQGAITVRWGEAPDQICHISYELTEQQINAAITRMNAICR

SEQ ID NO: 15790 - protein, 229 aa, Escherichia coli M863
MTLSIFAVLSLLVAGELQAGVVVGGTRFIFPAHRESISISLTNTSQESWLINSKINRSTRWAGGEASTVPVPLLAAPPLVFLKPSTTGTLRLLRTESDMLPVDRETLFELNIASVPSGKVENQNVKVAMRSVFKLFWRPEGLPGDPLEAYQQLRWSRNSQGLQLTNPTPYYINLIQVSVNGKALSNAGVVPPKSQRQTSWCQAIAPCHVAWRAINDYGGLSAKKEQDLP

SEQ ID NO: 15791 - protein, 517 aa, Escherichia coli M863; identical to SEQ ID NO: 6817

SEQ ID NO: 15792 - protein, 191 aa, Escherichia coli M863; identical to SEQ ID NO: 5748

SEQ ID NO: 15793 - protein, 232 aa, Escherichia coli M863; identical to SEQ ID NO: 5747

SEQ ID NO: 15794 - protein, 729 aa, Escherichia coli M863
MLSTQFNRDNQHQTTSKPSLLAACIALALLPSAAFAAPATEETVIVEGSATTPVDDENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYNNYGPGFDYVGGTGWNSGKRKVDALDLFADGSYELFGRQHNLMFGGSYSKQNNRYFSSWANIFPDEIGSFYNFNGNFPQTDWSPQNLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 15795 - protein, 213 aa, Escherichia coli M863; identical to SEQ ID NO: 5744

SEQ ID NO: 15796 - protein, 432 aa, Escherichia coli M863; identical to SEQ ID NO: 5727

SEQ ID NO: 15797 - protein, 567 aa, Escherichia coli M863
MKIKLRITIILISVLCIFNGLLTPGAYAAAANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGGGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFASRNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 15798 - protein, 360 aa, Escherichia coli M863; identical to SEQ ID NO: 6702

SEQ ID NO: 15799 - protein, 686 aa, Escherichia coli M863
MFWRDITLSVWRKKTTGLKTKKRLLPLVLAAVLCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 15800 - protein, 840 aa, Escherichia coli M863
MNNKNTFTGDKLSYAIKNALSGVVFSLLFVLPVRAVEFNADMIDVEDRANIDLSRFEKKGYITPAKYLVRVQINKNMLPQALMLEWAKADNESGSLLCLTKENLTNFGLNTDFIESLQTIAGSECLDLSQRQELTIRLDKATMILSLSIPQAWLKYQATNWTPPEFWDDGIAGFILDYNIYASQYSPQQGDSTQNVSSYGTLGFNLGAWRLRSDYQYNQNFADGRSVSHSGEFARTYLFRPIPSWSSKFTMGQYDLSSNLYDTFHFTGASLESDESMLPPDLQGYAPQITGIAQTNAKVTVAQNGRVLYQTTVAPGPFTITDLGQSFQGQLDVTVEEEDGRTNTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSDNLRGYSYRFNYAKHFESTGSQITFAGYRFSDKDYVSMNEYLNSRNGDESIDNEKESYVISLNQYFESLELNSYVNVTRNTYWDSPANTNYSISVSKNFDIGDFKGISASLAVSRIRWDDDEENQYYFSFSLPLQQSRNLSYSMQRTGGSNTSQMVSWYDSSDRNNIWNISASATDDNIRDGEPTLRGSYQHNSPWGRLNFTGSVQPNQYNSVTAGWYGSITATRHGVALHDYSYGDNARMMVDTDGIPGVEINSNRTVTNGLGIAVIPSLSNYTTSMLRVNNNVLPEGVDVENSVIRTTLTQGAIGYAKLNATTGYQIVGVIRQENGRFPPLGVNVTDKSTGKDVGLVAEDGFVYLSGIQENSTLHLTWGNNSCEITPPNQSNINESAIILPCKTVN

SEQ ID NO: 15801 - protein, 249 aa, Escherichia coli M863
MKKMKSLLTVTGMICLLGFCNFAQATVSPDRTRIIFNASNKSATVRLTNQSKIDPYLAQSWIEDASGKKTRDYISTLPPMERIEANEQVQIRLMALSALNNLPQDRETLFYYNVREIPPRAKEQNVMQIAMQSRLKLFWRPKSIELKEGEMVPLQKLTITHSAAGLTLNNPTPYHITVGYIGTNGKTLMPGTDSIMVTPFGTATQQIKNLPTTFLLGFVGDYGGLEMFKIDCNSVQSLCQATPAKKGKL

SEQ ID NO: 15802 - protein, 678 aa, Escherichia coli M863
MVPSTFSRLKAARCLPVVLAALIFAGCGTHTPDQSTAYMQGTAQADSAFYLQQMQQSADDTRINWQLLAIRALVKEGKTGQAVELFNQLPQELNDYQRREKTLLAVEIKLAQKDFAGAQTLLAKITPADLDQNQQARYWQAKIDASQGRPSIDLLRALIAQEPLLGAKEKQQNIDATWQALSSMTQDQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQATAAPIADVAEQPQQQTVDGVASPAQASVSDLTGEETAAQPVPVSAPAANTAAVSAPANPSAELKIYDTSSQPLSQILNQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRETTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 15803 - protein, 412 aa, Escherichia coli M863
MKQWIAALLLMLIPGVQAAKPQKVTLMVDDVPVAQVLQALAEQEKLNLVVSPDVSGTVSLHLTDVPWKQALQTVVKSAGLITRQEGNILSVHSVAWQNDNIARQEAEQARAQANLPLENRSITLQYADAGELAKAGEKLLSAKGSMTVDKRTNRLLLRDNKAALSALEQWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 15804 - protein, 210 aa, Escherichia coli M863
MTCAGVVIGGTRVVYLSNNADKSISVFSKEEKIPYLIQAWVDPFNKDDKTKAPFIVIPPVSRLEPAQEKILRIVHTKGLSLPEDRESVFWLNIKNIPPSASSKEANSLEIAVKTRIKLFWRPASIRMIPEDAAPKVKWHREGRNLIAENPNPIHISVMDVIVDGHDVPLNMIRPFETLTLPLPANSSGSQMTWRFINDYGAISEPLKQAL

SEQ ID NO: 15805 - protein, 446 aa, Escherichia coli M863
MMITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNGSSSTNPYYGKAVPADFNGGSFGRGDSDEWTFGAQMEIWW

SEQ ID NO: 15806 - protein, 237 aa, Escherichia coli M863
MRKITQAISAVCLLFALNSSAVALASSPSPLNPGTNVARLAEQAPIHWVSVVQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAAREVGARGIRILRASNSTYKPLPQAGAFGEEVIVNSEY

SEQ ID NO: 15807 - protein, 478 aa, Escherichia coli M863
MTRIKINARRIFSLLIPFFFFTSVHAEQTAAPTKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTVGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 15808 - protein, 368 aa, Escherichia coli M863
MNKTITALAIMMASFAANASVLPETPVPFKSGTGAIDNDTVYIGLGSAGTAWYKLDTQAKDKKWIALAAFPDGARDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGMSNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 15809 - protein, 241 aa, Escherichia coli M863
MSNKNVNVRKLQEITFCLLAGILMIMAMMAAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVMV

SEQ ID NO: 15810 - protein, 878 aa, Escherichia coli M863
MSYLNLRLYQRNTQCLHIRKPRLAGFFVRLSVACVFATQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTTMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQDKPRFFQSTLLHGLPAGWTIYGGTQLADRYRAFNFGIGKNMGALGALSVDMTQANSTLPDDSQHDGQSVRFLYNKSLNESGTNFQLVGYRYSTSGYFNFADTTYSRMSGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNINIPFSHWLRSDSKSQWRHASASYSMSHDLNGRMTNLAGVYGTLLEDNNLSYSVQTGYAGGGDGNSGSTGYAALNYRGGYGNANIGYSHSDDIKQLYYGISGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 15811 - protein, 351 aa, Escherichia coli M863
MKKSTLALVVMGIVASASVQAAEIYNKDGNKLDIYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 15812 - protein, 230 aa, Escherichia coli M863
MMTKIKLLMPIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVRGKLKFQTVNDYGSVTPVREVNLN

SEQ ID NO: 15813 - protein, 869 aa, Escherichia coli M863; identical to SEQ ID NO: 8606

SEQ ID NO: 15814 - protein, 360 aa, Escherichia coli M863; identical to SEQ ID NO: 8317

SEQ ID NO: 15815 - protein, 161 aa, Escherichia coli M863; identical to SEQ ID NO: 5769

SEQ ID NO: 15816 - protein, 266 aa, Escherichia coli M863; identical to SEQ ID NO: 8089

SEQ ID NO: 15817 - protein, 747 aa, Escherichia coli M863
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEIQFKAGTDSLFQTGFDFSDALDDDGVYSYRLTGIARSANAQQKGAEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPANSGPYRILNKQKQTGVYVQDQAQWDKVLVTLGGRYDWADQESHNRVEGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFEGPLSGLTLGTGGRFTGSSYGDPANSFKVGSYTVVDALVRYDLARVGMAGSNVALHVNNLFDREYVASCFNTYGCFWGAERQVVATATFRF

SEQ ID NO: 15818 - protein, 244 aa, Escherichia coli M863
MCQFVVSAVFIASTAVFSLTAQADIVLSGTRIIYNADQKDVTLRMENKGARPLLVQTWIDTGSENADPSTLKVPFTVTPPVSRVDGKKGQTVKIAWNASQTLPADRESIYWFNALEVPPKMSDADAKGKNILQLAFRTRIKLFYRPTGLAGNPADAPKQLTWRLQSSAGKVVLQATNPTPYHVSFSSITLGSGGNKYTVETSMVAPMSSAEMVVKGAPRSVSGATVDYSAINDFGGGIDGQVKL

SEQ ID NO: 15819 - protein, 868 aa, Escherichia coli M863
MKLPYDGKKIQRSPLACLIACSLLPCTQNVWGADETVEFDNTFLMGAGARDIDVNRYSKGNATLPGRYDVSVFINNQASANLKIEFIELDPKHAAQPCISANTLLQLHIRQPEKLTDNAILQKRENAAQDCLNLEVAIPQSSVAYNSNDQRLDISMPQIWLQRTYANYVDASLWDEGINAAMLSYTLNGWRSESPNQTTETSYAGLMGGINLWGWHFRSHGNYSWDKEDGGSFEFQDKYLQRDIAALRSQLVMGETNTTGETFDSVPIRGMRLYSESRMLPPTLASYAPVIRGVANSNAKVTITQNGYKIYETTVPPGPFAIDDLTPAGFGADLEVTITESDGSKRTFSQAYSSVIQMMRPGVGKWDISGGEVNKEELQDKPNLLQGTYYYGLSNTFTGYTGLQMTDNGYWAGLLGVGMNTSLGAFSFDVTQSHAEIPDDKTYSGQSYRISWNKYFAPTETSLNIAAYRYSTENYLGLNDALTLINSANHPDEEDYSGIVSYARMKNQFSVSINQTLKSDERDYGSFYVNGTWTDYWVTNESQSSFSFGYSNSFNWASYSVSLQRTYDEDNKKDDSVYLSVTIPLDKLLGRDSRQGGFKTLNTSVNSDMKGSSQYNAIASGYSQDNRWSYSVNTAYNAQKNSDSLKSISGYTSYESPWGTFSGSASTSSDHSRQYGLSTDGGFVLHRHGLTFSNDSFTDSDTLALINAPGAKGARINFGNSTIDRFGYGVSSSLSPYRENTVVLDVNDLDNDVELKNTSSIAIPRQGSVIFSHFDTDTGRSAILNLLRSNNQPVPFASDITDEKGTSIGTVGQGSQAFVRGIADSGELTVTWYEKNSRQQCRIHYQIPSSPTMTGKTIVLNGVPCTQQ

SEQ ID NO: 15820 - protein, 784 aa, Escherichia coli M863; identical to SEQ ID NO: 14072

SEQ ID NO: 15821 - protein, 136 aa, Escherichia coli M863
MPNNLPHNKESLFYLNVIDIPPNNPQNAGKNKIKLALQNRIKLFWRPEGVAPVDKKSLSQLNIKKKDNAISINNETANWITVTTIKAQNVKVNNESILLPPFSNNDITLKNNNASEYELTVVDDYGNNINSKIAAK

SEQ ID NO: 15822 - protein, 270 aa, Escherichia coli M863
MQMLPDSMQSFTPLVQGIAQSNALITVSQNGYIIYQKEVPPGPFTIADLQLSGSGSDLDVSIKEADGSVRSFLVPYSSVPNMLQPGVSNFDFIAGRSKIYGVKNQEDFLEANYIYGLNNLLTLYGGTILSDNYNAITLGNGWNTPLGAISFDATRSSSKLNNDITHEGTSYQVAYNKYLVQTATRFSVAAWRYASQDYRTFSDHLYENDKHNHHSEYDDFYDIGRKNSLSANIMQPLSTGIKIALNDEQNLFCTITFKNVIDENKTYICQ

SEQ ID NO: 15823 - protein, 656 aa, Escherichia coli M863
MRLKKRYLCTVLSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITPQKPTKPLEASLGYRQGWSRSQDNAYDMHASFAASSDLGYLQVSGSQLKQDFLGLPHGVNNDIAGKHGKMINSSADDKRGIVKLGFTPRENEEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGVEYTF

SEQ ID NO: 15824 - protein, 565 aa, Escherichia coli M863
MKATAPPRPQKIALIPACVLLCFAALAVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 15825 - protein, 207 aa, Escherichia coli M863
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKNWKVVYGGYDTKTQPAMPSNMELTDGGQRIKLKMDNWIVK

SEQ ID NO: 15826 - protein, 241 aa, Escherichia coli M863
MLKMFILFLISFSWYANATDFVYRVDSRPPEEIFRDGFRSHGFNRNLQQHLRGDSCAAGSRDSAFIATTTSLIETYNIARQYYSSSGFHGRLYRYRIRANNIFYPIQPSVNYLTQRGITFSGFERIMMREQNEIVAVEHIPGENIVEAVELTYDRFNSQVSDGPGTTNARYVPGSTFVNPGVIPQLVVPTVSVRERINAFGSLISACFALKGVRRDGLNKRATYYEPEFYDARGVLKEIIK

SEQ ID NO: 15827 - protein, 259 aa, Escherichia coli M863
MIKHVLLFFVFISFSVSANDFFRADSRTPDEIRRAGGLLPRGQQEAYERGTPININLYEHARGTVTGNTRYNDGYVSTTTTLRQAHLIGQNILGSYNEYYIYVVAPAPNLFDVNGVLGRYSPYPSENEFAALGGIPLSQIIGWYRVSFGAIEGGMQRNRDYRGDLFRGLTVAPNEDGYQLAGFPSNFPAWREMPWSTFAPEQCVPNNKEFKGGVCISATNVLSKYDLMNFKKLLKRRLALTFFMSEDDFIGVHGERDEL

SEQ ID NO: 15828 - protein, 123 aa, Escherichia coli M863; identical to SEQ ID NO: 5982

SEQ ID NO: 15829 - protein, 119 aa, Escherichia coli M863
MDAVLSVQGASAPVKKKSFFSKFTRLNMLRLVRAVIPAAVLMMFFPQAALAAGGQDLMQSGNDTVKATFGKDSSIVKWVVLAEVLVGAVMYMMTKNVKFLAGFAIISVFIAIGMTVVGL

SEQ ID NO: 15830 - protein, 208 aa, Escherichia coli M863; identical to SEQ ID NO: 5717

SEQ ID NO: 15831 - protein, 614 aa, Escherichia coli M863
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDQPGTEISAGWGSNSYQNYDVSTQQQLGDKTRVTLLGDYAHTHGYDVVAYGNTGTQAQPDNDGFLSKTLYGALEHNFTDVWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLEPEKSKQWEGAFEGLTAGVNWRISGYRNDVSDLIDYDDHTLKYYNEGKARIKGVEAIANFDTGPLTHTVSYDYVDAHNAITDTPLLRRAKQQVKYQLDWQLYDFDWGITYQYLGTRYDKDYSSWPYQTVKMGGVSLWDLAVAYPVTSHLTVRGKIANLFDKDYETVYGYQTAGREYTLSGSYTF

SEQ ID NO: 15832 - protein, 366 aa, Escherichia coli M863
MKLKIVAVVVTGLLAANVAHAAEVYNKDGNKLDLYGKVTALRYFTDDKRDDGDKTYARLGFKGETQINDQMIGFGHWEYDFKGYNDEANGSRGNKTRLAYAGLKISEFGSLDYGRNYGVGYDIGSWTDMLPEFGGDTWSQKDVFMTYRTTGVATYRNYDFFGLIEGLNFAAQYQGKNERTDNAHLYGADYTRANGDGFGISSTYVYDGFGIGAVYTKSDRTNAQERAAANPLNASGKNAELWATGIKYDANNIYFAANYAETLNMTTYGDGYISNKAQSFEVVAQYQFDFGLRPSLAYLKSKGRDLGRYGDQDMIEYIDVGATYFFNKNMSTYVDYKINLIDESDFTRAVDIRTDNIVATGITYQF

SEQ ID NO: 15833 - protein, 883 aa, Escherichia coli M863
MTAFRAAFKAYRMHHVLLLPRFARLTFALGLATAVFPVEAEYYFNPRFLSNDLAESVDLSAFAKGREAPPGTYRVDIYLNDEFMTTRDVTFVADENNADLTPCLSTDLLVSLGIKKSALLANKDHLAGKNVPDNNACTPLQDRLADASTEFDVGQQHLSLSVPQIYVGRMARGYVSPDLWEEGINAGLLNYSFNGNSINNRSNHNASKTNYAYLNLQSGINIGSWRLRDNSTWSYNSGSNNPSDSNKWQHINTSAERDIIPLRSRLTVGDSYTDGDIFESVNFRGLKINSTEAMLPDSQHGFAPVIHGIARGTAQVSVKQNGYDVYQTTVPPGPFTIDDINSATNGGDLQVTIKEADGSIQTLYVPYSSVPVLQRVGYTRYALALGEYRSGNNLQSSPKFIQGSVMHGLEGNWTPYGGMQIAEDYQAFNVGIGKDLGLLGAFSVDITQANTTLADDTRHSGQSVKSVYSKSFYQTGTNIQIAGYRYSTQGFYNLSDSAYSRMSGYTVKPPTGDTNEQIQFIDYFNLYYSKRGQEQISISQQLGNYGTTFFSASRQSYWNTSRSDQQISFGLNVPFGDITTSLNYSYSSNIWQNDRDHLLAFTLNVPFSHWMRTDSQSAFRNSNASYSMSNDLKGSMTNLSGVYGTLLPDNNLNYSVQVGNTRGGNASSGTSGYSSLNYRGAYGNTNVGYSRNGDSNQIYYGMSGGIIAHADGVTFGQPMGDTMVLVKAPGAENVKIENQTGIHTDWRGYAILPFATEYRENRVALNANSLADNVELDETVVTVIPTHGAIARATFNAQIGGKVLMTLKYGNKPVPFGAIVTHGDNNNGSIVAENGQVYLTGLPQSGKLQVSWGNNANAKCIVNYKLPEVSPGNLLSQQTAVCR

SEQ ID NO: 15834 - protein, 236 aa, Escherichia coli M863
MQTTRTPYSVSFMATVLLSLVFLCHSTIANAAVALGATRVIFPANQKQVLLPVTNNDPASVYLIQSWIENAGDQKDTQFVITPPLFSMQGKKENTLRIINATNHQLPGDRESLFWVNVKAIPAMEKDQKNANTLQLAIISRIKMFYRPTNLAMAPDQAPEMLRFRRSGSKLTLINPTPYFITVTNMKAGNSDLPNTMVPPKGEISVDFPHGASGDISFQTINDYGALTPRIKATMQ

SEQ ID NO: 15835 - protein, 551 aa, Escherichia coli M863; identical to SEQ ID NO: 5742

SEQ ID NO: 15836 - protein, 700 aa, Escherichia coli M863
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSSQDDMSVMMYAGERETTQYQSIPMAPQLNPSHAGGVITLQRHYQGIDSRWTHRGELGVPVTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRIKASWTWLDATYRSNVCNDQDCNGNRMPGIARNMGFSSIGYVPEDGWYAGTEARYMGDIMADDENTAKAPSYTLVGLFSGYKYNYHNLTVDLFGRVDNLFDKEYVGSVIVNESNGRYYEPAPGRNYGIGVNVAWRFE

SEQ ID NO: 15837 - protein, 800 aa, Escherichia coli M863
MFFRRAALALAVSAAFASVTGIAGEKLDMSFIQGGAGVNPEIWAALSGSYAPGRYLVDLSLNGKEVGKQILDVTPQDSNELCLTEAWLTKAGIYVSADYFREGYDATRQCYVLTKALSVKVDFDVSTQSLALSIPQKGLMKMPENVEWDYGTSAFRVNYNANANTGRNNTSAFGSADLKANIGRWVVSSSATASGGDSGDNSTTINMFTATRAIRALSADLAVGKTSTGDSLLGSTGTYGVSLSRNNSMKPGNLGYTPVFSGIANGPSRVTLTQNGRLLHSEMVPAGPFSITDVPLYTSGDVTMKITGEDGREQVQNFPLSVMAGQLSPGQHEFSVAAGLPDDDSDLKGGVFAASYGYGLDGLTLRTGGVFNQDWQGVSAGAVLGLSYLGAVSADGAYATVKYRDGSRSGNKVQLSWSKQLDMTNTGLRVSWSQQSEEYEDMSSFDPTDLWSQSNHGRRTKDEWNAGVSQPVGGLFSLSVSGWQRSYYPASTTGSYRYSDDNGKDTGITGTLSTQIKGVSLNLGWSGSRNTRGENNWSASASVSVPFTLFDRRYSSSTSVSTSKDGGTGFSTGVSGSLNDRFSYGLGGGRDSGGGVSSYLNASYSGDRAYLNGALNHSQSVGTSGSVSVSGSVLAIPAAKDIMFSRTTGDTVAVVSVKDTPGVKVTSGDGQTDSDGNLVVPLNSYDWNTVTIDAGTLPLSTELMNTSQKVVPTDKAVVWMPFDALKIKRYLLQVKLRDGEFVPGGTWARDSKNTPLGFVSSNGVLMINTVDAPGDITLGQCRIPAARLQDTEKLQEITCE

SEQ ID NO: 15838 - protein, 253 aa, Escherichia coli M863
MSKRNAVMTFFTNRVTKVLGMTLALMMTCQSAMASLAADQTRYIFRGDKDSLTITVTNNDRERTFGGQAWVDNIVEKDTRPTFVVTPSFFKVKPNGQQTLRIIMASDHLPKDKESVYWLNLQDIPPALEGSGIAVALRTKLKLFYRPKALLEGRKGAEEGISLQSRPDGRIMLVNTTPYIFAIGSLLDGNGKKIATDNETAQKLLMFMPGDEVQVKGNVVKVDSLNDWGSLQTWTINQKKLAVPEVTKADTAE

SEQ ID NO: 15839 - protein, 58 aa, Escherichia coli M863
MREDKLKYLLEIYRENERKIKELEQIKSHISQLEVAVLRINNLKVREDIDSLLKSYNY

SEQ ID NO: 15840 - protein, 72 aa, Escherichia coli M863
MKKLMLAIFISVLSFPSFSQKAESVDSSKEKITLDTKKCNVVKNNSEKKSENMNNTFYCCELCCNPACAGCY

SEQ ID NO: 15841 - protein, 539 aa, Escherichia coli M863
MTVNKIKNIFSNATSTTKSAFNTASSNVRTAGKKLILLIPDDYEAQGVGINELVKAADELGIEIHRTERDDTAIANQFFGTAEKVLGLTERGVAIFAPQLDKLLQKYQNVGSKIGGTAENVGNNLGKAGTVLSALHNFTGIALSGMALDELLRKQRGGEDISQNDIAKNSIELINHLVDTVSSINSTVDSFSEQLNQLGSFLSSKPSLSSVGGKLQNLPDLGPLGDGLDVISGILSAVSASFILGNSDAHTGTKAAAGIELTTQVLGNVGKAVSQYILAQRMAQGLSTTAASAGLITSAVMLAISPLSFLAIADKFERAKQLEAYSERFKKLNYEGDALLAAFHKETGAIDAALTTINTVLSSVSAGVSAASSASLIGAPISMLVSALTGTISGILEASKQAMFEHVADKFAARINEWEKEHGKNYFENGYDARHAAFLEDSLSLLADFSRQHAVERAVAITQQHWDEKIGELAGITRNADRSQSGKAYINYLENGGLLEDQPKEFTQQVFDPQKGTIDLSTGNVSSVLTFVTPTRLAP

SEQ ID NO: 15842 - protein, 473 aa, Escherichia coli M863
MSGNIGANPPTFTPGEEVRERKQSGKYEYMTSLIVNGKDTWSVKGLKSHKGVYDYSNLIQFVEKDNKYHQAKIISELGDKNDIVYSGSGSSEVFAGEGHDTVSYNKTDAGKLTIDATGASKPGEYIVSKNMYGDVKVLQEVVNEQEVSVGKRTEKIQYRDFEFRAGGISYDVIDKLHSVEELIGGKHDDEFKGGKFNDIFHGADGNDYIEGNYGNDRLYGDDGDDYISGGQGDDQLFGGSGNDKLSGGDGNNYLTGGSGNDELQAHGAYNILSGGTGDDKLYGGGIDLLDGGEGNDYLNGGFGNDIYVYRQNYGHHTIADEGGKGDRLHLSDISFDDIAFKKVGNDLIMNKAINGVLSFNESNDVNGITFKNWFAKDASGADNHLVEIITDKDGREIKSDNIPHKNNDWSGYIKASSIASEKNMVNITSVANDINKIISSVSGLDSGDERLASLYNLALHQNNTHSTILTTTV

SEQ ID NO: 15843 - protein, 386 aa, Escherichia coli MS 107-1; identical to SEQ ID NO: 7993

SEQ ID NO: 15844 - protein, 132 aa, Escherichia coli MS 107-1; identical to SEQ ID NO: 15573

SEQ ID NO: 15845 - protein, 228 aa, Escherichia coli MS 107-1; identical to SEQ ID NO: 6185

SEQ ID NO: 15846 - protein, 843 aa, Escherichia coli MS 107-1; identical to SEQ ID NO: 6288

SEQ ID NO: 15847 - protein, 360 aa, Escherichia coli MS 107-1
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLQSRNNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 15848 - protein, 432 aa, Escherichia coli MS 107-1; identical to SEQ ID NO: 5727

SEQ ID NO: 15849 - protein, 825 aa, Escherichia coli MS 107-1
MGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARLSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 15850 - protein, 230 aa, Escherichia coli MS 107-1; identical to SEQ ID NO: 7855

SEQ ID NO: 15851 - protein, 747 aa, Escherichia coli MS 107-1; identical to SEQ ID NO: 6343

SEQ ID NO: 15852 - protein, 266 aa, Escherichia coli MS 107-1; identical to SEQ ID NO: 5772

SEQ ID NO: 15853 - protein, 161 aa, Escherichia coli MS 107-1; identical to SEQ ID NO: 5769

SEQ ID NO: 15854 - protein, 784 aa, Escherichia coli MS 107-1; identical to SEQ ID NO: 6283

SEQ ID NO: 15855 - protein, 431 aa, Escherichia coli MS 107-1; identical to SEQ ID NO: 6791

SEQ ID NO: 15856 - protein, 122 aa, Escherichia coli MS 107-1; identical to SEQ ID NO: 5737

SEQ ID NO: 15857 - protein, 700 aa, Escherichia coli MS 107-1
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDESGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 15858 - protein, 245 aa, Escherichia coli MS 107-1; identical to SEQ ID NO: 15432

SEQ ID NO: 15859 - protein, 819 aa, Escherichia coli MS 107-1; identical to SEQ ID NO: 6642

SEQ ID NO: 15860 - protein, 331 aa, Escherichia coli MS 107-1
MKKPVVIGLAVVALAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGNEAGHE

SEQ ID NO: 15861 - protein, 733 aa, Escherichia coli MS 107-1
MAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 15862 - protein, 267 aa, Escherichia coli MS 107-1
MTLYTPAIVCISRQKNVKKQRAENMQKMKPALKKTLMAVACLSAVPAAQAAVSLDRTRAIFNGDEKSMTLNIANDNKQLPYLAQAWVENEKKEKITTGPIIATPPVQRLEPGSKSMVRLTSTPDISRLPQDRESLFYFSLREIPPKSDKANVLQIALQTKIKLFYRPESIKAKPNAVWQDQLVLNKTSGGYRIDNPTPYYVTVIGIGGSEKQAREGEFDAVMLAPKSTQMVKSGTYNTPYLSYINDYGGRPVLQFSCGGSRCTAVKK

SEQ ID NO: 15863 - protein, 836 aa, Escherichia coli MS 107-1; identical to SEQ ID NO: 14687

SEQ ID NO: 15864 - protein, 554 aa, Escherichia coli MS 107-1
MALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 15865 - protein, 207 aa, Escherichia coli MS 107-1; identical to SEQ ID NO: 5743

SEQ ID NO: 15866 - protein, 517 aa, Escherichia coli MS 107-1; identical to SEQ ID NO: 6817

SEQ ID NO: 15867 - protein, 191 aa, Escherichia coli MS 107-1; identical to SEQ ID NO: 5748

SEQ ID NO: 15868 - protein, 235 aa, Escherichia coli MS 107-1
MIAMQKNAAHTYAISSLLVLSLTGCAWIPSTPLVQGATSAQPVPGPTPVANGSIFQSAQPINYGYQPLFEDRRPRNIGDTLTIVLQENVSASKSSYANASRDGKTNFGFDTVPRYLQGLFGNARADVEASGGNTFNGKGGANASNTFNGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 15869 - protein, 729 aa, Escherichia coli MS 107-1
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTQGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWTNIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 15870 - protein, 213 aa, Escherichia coli MS 107-1; identical to SEQ ID NO: 5744

SEQ ID NO: 15871 - protein, 204 aa, Escherichia coli MS 107-1; identical to SEQ ID NO: 5755

SEQ ID NO: 15872 - protein, 353 aa, Escherichia coli MS 107-1
MKMKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 15873 - protein, 221 aa, Escherichia coli MS 107-1
MKNYLWLVALLPLLSGCESQAILVKKDDAYFAPPKTEAPPPADGRAGGVFETGYNWSLTADRRAYRVGDILTVILEESTQSSKQAKTNFGKSNTVDIGAPTIFGHTKDKLSGSIDANRDFDGSATSQQQNSLRGEITVSVHAVQPNGILEIRGEKWLTLNQGDEYIRLSGLARADDIQNDNSVSSQRIADARISYAGRGALSDANAAGWLTRLFNHPLFPI

SEQ ID NO: 15874 - protein, 861 aa, Escherichia coli MS 107-1
MSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 15875 - protein, 250 aa, Escherichia coli MS 107-1; identical to SEQ ID NO: 10481

SEQ ID NO: 15876 - protein, 274 aa, Escherichia coli MS 107-1; identical to SEQ ID NO: 7373

SEQ ID NO: 15877 - protein, 813 aa, Escherichia coli MS 107-1
MVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 15878 - protein, 231 aa, Escherichia coli MS 107-1
MSKRTFAVIITLLCSFCIGQALAGGIVLQRTRVIYDASRKEAALPVANKGAETPYLLQSWVDNIDGTSRAPFIITPPLFRLEAGDDSSLRIFKTADNLPENKESLFYINVRAIPAKKKSDDVNANELTLVFKTRFKMFYRPAHLKGRVNDAWTSLEFKRSDHSLNIYNPTEYYVVFAGLAVDKTDLTSKIEYIAPGEHKQLPLPASGGKNVKWAAINDYGGSSGTETRPLQ

SEQ ID NO: 15879 - protein, 518 aa, Escherichia coli MS 107-1; identical to SEQ ID NO: 7565

SEQ ID NO: 15880 - protein, 746 aa, Escherichia coli MS 107-1; identical to SEQ ID NO: 10445

SEQ ID NO: 15881 - protein, 446 aa, Escherichia coli MS 107-1; identical to SEQ ID NO: 6459

SEQ ID NO: 15882 - protein, 478 aa, Escherichia coli MS 107-1; identical to SEQ ID NO: 5711

SEQ ID NO: 15883 - protein, 219 aa, Escherichia coli MS 107-1; identical to SEQ ID NO: 6490

SEQ ID NO: 15884 - protein, 368 aa, Escherichia coli MS 107-1
MKVKVLSLLVPALLVAGAANAAEVYNKDGNKLDLYGKVDGLHYFSDNKDVDGDQTYMRLGFKGETQVTDQLTGYGQWEYQIQGGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVNGEGMTNNGRDALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGTIAGRNYDDEDILKYVDVGATYYFNKNMSTYVDYKINLLDDNQFTRDAGINTDNIVALGLVYQF

SEQ ID NO: 15885 - protein, 169 aa, Escherichia coli MS 107-1; identical to SEQ ID NO: 8240

SEQ ID NO: 15886 - protein, 541 aa, Escherichia coli MS 107-1; identical to SEQ ID NO: 6286

SEQ ID NO: 15887 - protein, 856 aa, Escherichia coli MS 107-1
MAGFFVRLVVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSIIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 15888 - protein, 241 aa, Escherichia coli MS 107-1; identical to SEQ ID NO: 6134

SEQ ID NO: 15889 - protein, 368 aa, Escherichia coli MS 107-1; identical to SEQ ID NO: 7974

SEQ ID NO: 15890 - protein, 834 aa, Escherichia coli MS 107-1; identical to SEQ ID NO: 8715

SEQ ID NO: 15891 - protein, 252 aa, Escherichia coli MS 107-1; identical to SEQ ID NO: 7371

SEQ ID NO: 15892 - protein, 154 aa, Escherichia coli MS 107-1; identical to SEQ ID NO: 9702

SEQ ID NO: 15893 - protein, 831 aa, Escherichia coli MS 107-1
MQELPMLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRFGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 15894 - protein, 663 aa, Escherichia coli MS 107-1; identical to SEQ ID NO: 6307

SEQ ID NO: 15895 - protein, 331 aa, Escherichia coli MS 107-1
MADLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 15896 - protein, 233 aa, Escherichia coli MS 107-1; identical to SEQ ID NO: 6327

SEQ ID NO: 15897 - protein, 851 aa, Escherichia coli MS 107-1; identical to SEQ ID NO: 8686

SEQ ID NO: 15898 - protein, 236 aa, Escherichia coli MS 107-1; identical to SEQ ID NO: 6329

SEQ ID NO: 15899 - protein, 208 aa, Escherichia coli MS 107-1; identical to SEQ ID NO: 5717

SEQ ID NO: 15900 - protein, 111 aa, Escherichia coli MS 107-1; identical to SEQ ID NO: 7885

SEQ ID NO: 15901 - protein, 614 aa, Escherichia coli MS 107-1; identical to SEQ ID NO: 7971

SEQ ID NO: 15902 - protein, 224 aa, Escherichia coli MS 107-1
MATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDITHAATGDISFQTINDYGALTPRIKATMQ

SEQ ID NO: 15903 - protein, 883 aa, Escherichia coli MS 107-1
MTAIRAAFKAYRMHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYYSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPETLLNQQTAICR

SEQ ID NO: 15904 - protein, 230 aa, Escherichia coli MS 107-1; identical to SEQ ID NO: 7352

SEQ ID NO: 15905 - protein, 869 aa, Escherichia coli MS 107-1; identical to SEQ ID NO: 10176

SEQ ID NO: 15906 - protein, 700 aa, Escherichia coli MS 110-3; identical to SEQ ID NO: 7559

SEQ ID NO: 15907 - protein, 541 aa, Escherichia coli MS 110-3
MAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKNQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 15908 - protein, 614 aa, Escherichia coli MS 110-3; identical to SEQ ID NO: 7540

SEQ ID NO: 15909 - protein, 208 aa, Escherichia coli MS 110-3; identical to SEQ ID NO: 5869

SEQ ID NO: 15910 - protein, 307 aa, Escherichia coli MS 110-3
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSG

SEQ ID NO: 15911 - protein, 432 aa, Escherichia coli MS 110-3; identical to SEQ ID NO: 5727

SEQ ID NO: 15912 - protein, 249 aa, Escherichia coli MS 110-3; identical to SEQ ID NO: 7529

SEQ ID NO: 15913 - protein, 840 aa, Escherichia coli MS 110-3; identical to SEQ ID NO: 7530

SEQ ID NO: 15914 - protein, 222 aa, Escherichia coli MS 110-3; identical to SEQ ID NO: 7531

SEQ ID NO: 15915 - protein, 713 aa, Escherichia coli MS 110-3; identical to SEQ ID NO: 6056

SEQ ID NO: 15916 - protein, 681 aa, Escherichia coli MS 110-3
MTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPVIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 15917 - protein, 229 aa, Escherichia coli MS 110-3; identical to SEQ ID NO: 7628

SEQ ID NO: 15918 - protein, 554 aa, Escherichia coli MS 110-3
MALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDNYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAIGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 15919 - protein, 656 aa, Escherichia coli MS 110-3; identical to SEQ ID NO: 7494

SEQ ID NO: 15920 - protein, 274 aa, Escherichia coli MS 110-3; identical to SEQ ID NO: 5899

SEQ ID NO: 15921 - protein, 242 aa, Escherichia coli MS 110-3
MLVSTALMALLTTASLTAHASVTPDRTRLVFNESDKSISVTLRNNTEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRRPWQFKVTLTRSGQDYTVNNPTPYHVIISDASTQKKGLTAAGFKPLVMPPKTSQPLKAKMASAPVLTYINDYGARMPLIFRCEGNTCKVDEDQSSKG

SEQ ID NO: 15922 - protein, 781 aa, Escherichia coli MS 110-3
MAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGGADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 15923 - protein, 478 aa, Escherichia coli MS 110-3; identical to SEQ ID NO: 6796

SEQ ID NO: 15924 - protein, 260 aa, Escherichia coli MS 110-3; identical to SEQ ID NO: 6790

SEQ ID NO: 15925 - protein, 446 aa, Escherichia coli MS 110-3; identical to SEQ ID NO: 5873

SEQ ID NO: 15926 - protein, 353 aa, Escherichia coli MS 110-3; identical to SEQ ID NO: 7654

SEQ ID NO: 15927 - protein, 721 aa, Escherichia coli MS 110-3; identical to SEQ ID NO: 15114

SEQ ID NO: 15928 - protein, 362 aa, Escherichia coli MS 110-3; identical to SEQ ID NO: 5874

SEQ ID NO: 15929 - protein, 204 aa, Escherichia coli MS 110-3; identical to SEQ ID NO: 5755

SEQ ID NO: 15930 - protein, 360 aa, Escherichia coli MS 110-3; identical to SEQ ID NO: 5879

SEQ ID NO: 15931 - protein, 213 aa, Escherichia coli MS 110-3; identical to SEQ ID NO: 5744

SEQ ID NO: 15932 - protein, 729 aa, Escherichia coli MS 110-3; identical to SEQ ID NO: 6821

SEQ ID NO: 15933 - protein, 191 aa, Escherichia coli MS 110-3; identical to SEQ ID NO: 5748

SEQ ID NO: 15934 - protein, 517 aa, Escherichia coli MS 110-3; identical to SEQ ID NO: 6817

SEQ ID NO: 15935 - protein, 760 aa, Escherichia coli MS 110-3
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYNDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNIYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 15936 - protein, 331 aa, Escherichia coli MS 110-3; identical to SEQ ID NO: 7536

SEQ ID NO: 15937 - protein, 431 aa, Escherichia coli MS 110-3; identical to SEQ ID NO: 6791

SEQ ID NO: 15938 - protein, 746 aa, Escherichia coli MS 110-3; identical to SEQ ID NO: 6783

SEQ ID NO: 15939 - protein, 244 aa, Escherichia coli MS 110-3; identical to SEQ ID NO: 6111

SEQ ID NO: 15940 - protein, 836 aa, Escherichia coli MS 110-3; identical to SEQ ID NO: 15043

SEQ ID NO: 15941 - protein, 682 aa, Escherichia coli MS 110-3; identical to SEQ ID NO: 6110

SEQ ID NO: 15942 - protein, 719 aa, Escherichia coli MS 110-3; identical to SEQ ID NO: 8210

SEQ ID NO: 15943 - protein, 845 aa, Escherichia coli MS 110-3
CAFAAQAPLSSAELYFNPRFLADDPQAVADLSRFENGQELPPGTYRVDIYLNNGYMATRDVTFNTGDSEQGIVPCLTRAQLASMGLNTASISGMNLLADDACVPLTDMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGIYGTLLEDNDLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 15944 - protein, 241 aa, Escherichia coli MS 110-3; identical to SEQ ID NO: 6143

SEQ ID NO: 15945 - protein, 368 aa, Escherichia coli MS 110-3; identical to SEQ ID NO: 15126

SEQ ID NO: 15946 - protein, 673 aa, Escherichia coli MS 110-3; identical to SEQ ID NO: 6170

SEQ ID NO: 15947 - protein, 220 aa, Escherichia coli MS 110-3
TQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGLVYQF

SEQ ID NO: 15948 - protein, 122 aa, Escherichia coli MS 110-3; identical to SEQ ID NO: 5737

SEQ ID NO: 15949 - protein, 111 aa, Escherichia coli MS 110-3; identical to SEQ ID NO: 5889

SEQ ID NO: 15950 - protein, 224 aa, Escherichia coli MS 110-3; identical to SEQ ID NO: 8215

SEQ ID NO: 15951 - protein, 883 aa, Escherichia coli MS 110-3; identical to SEQ ID NO: 15242

SEQ ID NO: 15952 - protein, 629 aa, Escherichia coli MS 110-3
MTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGVTTTLVLGNAFDKEYWSPQGIPQDGRNGKIFVSYQW

SEQ ID NO: 15953 - protein, 250 aa, Escherichia coli MS 110-3; identical to SEQ ID NO: 5862

SEQ ID NO: 15954 - protein, 250 aa, Escherichia coli MS 110-3
MIKVVIVLFSLLFSTAQAGLVIGGTRFAYPENQSSISVELKNTSDRDMLVKVAVSPDDARQLTGTVESLPSYSETVFIATPPLFVLKPDKNTKIRINRVGGSLSADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDVYNNVLPAWKVKMNLLQMDVSGLQVKTD

SEQ ID NO: 15955 - protein, 386 aa, Escherichia coli MS 110-3; identical to SEQ ID NO: 5860

SEQ ID NO: 15956 - protein, 192 aa, Escherichia coli MS 110-3; identical to SEQ ID NO: 7823

SEQ ID NO: 15957 - protein, 363 aa, Escherichia coli MS 110-3
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFETVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 15958 - protein, 169 aa, Escherichia coli MS 110-3; identical to SEQ ID NO: 8640

SEQ ID NO: 15959 - protein, 728 aa, Escherichia coli MS 110-3; identical to SEQ ID NO: 8238

SEQ ID NO: 15960 - protein, 222 aa, Escherichia coli MS 110-3; identical to SEQ ID NO: 15116

SEQ ID NO: 15961 - protein, 831 aa, Escherichia coli MS 110-3; identical to SEQ ID NO: 7616

SEQ ID NO: 15962 - protein, 733 aa, Escherichia coli MS 110-3; identical to SEQ ID NO: 5674

SEQ ID NO: 15963 - protein, 725 aa, Escherichia coli MS 110-3; identical to SEQ ID NO: 15078

SEQ ID NO: 15964 - protein, 161 aa, Escherichia coli MS 110-3; identical to SEQ ID NO: 5769

SEQ ID NO: 15965 - protein, 266 aa, Escherichia coli MS 110-3; identical to SEQ ID NO: 7500

SEQ ID NO: 15966 - protein, 721 aa, Escherichia coli MS 110-3
MSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPDNSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 15967 - protein, 230 aa, Escherichia coli MS 110-3; identical to SEQ ID NO: 8200

SEQ ID NO: 15968 - protein, 825 aa, Escherichia coli MS 110-3
MGKDASNIDLSRYTEGNPTLPGIYDVSVYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVRIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNTTSEKIAQSIILNGLRCQIQ

SEQ ID NO: 15969 - protein, 784 aa, Escherichia coli MS 110-3; identical to SEQ ID NO: 6829

SEQ ID NO: 15970 - protein, 121 aa, Escherichia coli MS 110-3; identical to SEQ ID NO: 6175

SEQ ID NO: 15971 - protein, 900 aa, Escherichia coli MS 110-3; identical to SEQ ID NO: 7567

SEQ ID NO: 15972 - protein, 654 aa, Escherichia coli MS 110-3; identical to SEQ ID NO: 6816

SEQ ID NO: 15973 - protein, 518 aa, Escherichia coli MS 110-3; identical to SEQ ID NO: 7565

SEQ ID NO: 15974 - protein, 541 aa, Escherichia coli MS 115-1; identical to SEQ ID NO: 6286

SEQ ID NO: 15975 - protein, 243 aa, Escherichia coli MS 115-1; identical to SEQ ID NO: 6145

SEQ ID NO: 15976 - protein, 241 aa, Escherichia coli MS 115-1
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQVAEKLRFRRSANSLTLINPTPYYLTVTELNAGTRVLENALVPPMGESTVKLPSDAGSNITYRTINDYGALTPKMTGVME

SEQ ID NO: 15977 - protein, 856 aa, Escherichia coli MS 115-1
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINSGLLNYNFSGNSVQNRIGGNSHYAYLNLQSGLNIGAWRLRDNTTWSYNSSDRSSGSKNKWQYINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSADMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMNNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 15978 - protein, 252 aa, Escherichia coli MS 115-1
MKLMRYLNTKNIIAAGVLLSCMNSIAWGAIIPDRTRIIMNESDKGEALKLTNQSKKLPYLAQTWIEDTKGNKSRDFIVTVPPMVRLNPNEQIQIRMITQEKIAQLPKDRETLFYFNVREIPPKTDKKNVMQVTMQHALKLFWRPKAIELEDDGVMTYEKVEIIRRNDGSIRFNNKMPYHVTLGYIGTNGVTMLPQTQSLMVLPFSHADTQFKNVPSTFQVGYINDFGGLSFYEINCPTVNNSCNVSVAKRDK

SEQ ID NO: 15979 - protein, 832 aa, Escherichia coli MS 115-1
MYKKLKLTTISELIKNIYCSLSVIIIGCASAYAVEFNKDLIEAEDRENVNLSQFETDGQLPVGKYSLSTLINNKRTPIHLDLQWVLIDNLTAVCVTPEQLTLLGFTDEFIEKTQQTLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLATGVGFNLNSLGSLSFDVTRSDAQLHNQNKETGYSYRANYSKRFESTGSQLTFAGYRFSDKNFVSMNEYINDTNHYTNYQNEKESYIVTFNQYLESLRLNTYVSLARNTYWDASSNVNYSLSLSRDFDIGPLKNVSTSLTFSRINWEDDNQDQLYLNISIPWGTSRTLSYGMQRNQDNNISHTASWYDSSDRNNSWSVSASGDNDEFKDMEASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIIGVIRLPDGSHPPLGISVKDETSHKELGLVADGGFVYLNGIQDDSKLTLRWGDKSCFIQPPKSSNLTTGTVILPCIS

SEQ ID NO: 15980 - protein, 478 aa, Escherichia coli MS 115-1
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQTDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 15981 - protein, 614 aa, Escherichia coli MS 115-1; identical to SEQ ID NO: 6387

SEQ ID NO: 15982 - protein, 224 aa, Escherichia coli MS 115-1; identical to SEQ ID NO: 6435

SEQ ID NO: 15983 - protein, 831 aa, Escherichia coli MS 115-1
MQELPMLRMTPLASAIVALLLGIEAYAAEETFDTHFMIGGMKDQQVANIRLDDNQPLPGQYDIDIYVNKQWRGKYEIIVKDNPQETCLSREVIKRLSINSDNFASGKQCLTFEQLVQGGSYTWDIGVFRLDFSVPQAWVEELESGYVPPENWERGINAFYTSYSVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKHSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSYQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 15984 - protein, 700 aa, Escherichia coli MS 115-1
MKIFSVRQTVLPALLALSPVVFAADEQTMIVSAAPQVVSELDTPAAVSVVDGEGMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTIGLNYENMSENRKGYNNFRLNSGMPEYGQKGELRRDERNLMWNIDPYLQTQWQLSEKLSLDAGVRYSSVWFDSNDHYITPSNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLIGLFTGYKYNYHNLTVDLFGRVDNLFDKEYVGSVIVNESNGRYYEPAPGRNYGVGVNIAWRFE

SEQ ID NO: 15985 - protein, 446 aa, Escherichia coli MS 115-1; identical to SEQ ID NO: 8125

SEQ ID NO: 15986 - protein, 122 aa, Escherichia coli MS 115-1; identical to SEQ ID NO: 5737

SEQ ID NO: 15987 - protein, 751 aa, Escherichia coli MS 115-1
TDVWKYRGKSSLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTHHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 15988 - protein, 224 aa, Escherichia coli MS 115-1
MATVLLLLLFACHSCVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMLYRPTNLAMAPEEAPAMLRFRRSGSKLTLINPTPYFITVTNMKAGNSNLPNTMVPPKGEVSVDITHAATGDISFQTINDYGALTPRIKATMQ

SEQ ID NO: 15989 - protein, 650 aa, Escherichia coli MS 115-1
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSAQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYHSLSKEKYTRYRQEQQQRIDGKSKALVGSEDLPVLDENTFNSHAPAPSSR

SEQ ID NO: 15990 - protein, 897 aa, Escherichia coli MS 115-1
MKLNIFTKSMIGMGLVCSALPALAMEAWNNQQGGNKYQVIFDGKIYENAWWVSSTNCPGKAKVNDATNPWRLKRTATAAEISQYGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDARNPWRYVRAATATEISQYGNPGSCSVKPDNNGGAVTPVDPTPETPVTPTPDNSEPSTPADSVNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLKVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 15991 - protein, 245 aa, Escherichia coli MS 115-1; identical to SEQ ID NO: 15432

SEQ ID NO: 15992 - protein, 663 aa, Escherichia coli MS 115-1
MDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNISIPQAWLVWHSENWAPPSTWKEGVAGVLMDYNLFASNYRPQDGSNSTNLNAYGTTGINAGSWRLRSDYQLNNTDSEDSHEQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDILVPMPPMITVPSAAAGAVLSPQPNMVQRFIAAAPPMNHA

SEQ ID NO: 15993 - protein, 431 aa, Escherichia coli MS 115-1; identical to SEQ ID NO: 6791

SEQ ID NO: 15994 - protein, 861 aa, Escherichia coli MS 115-1
MSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSVNYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLSDGSHPPFGAEVKNDNEQTVGLVDDDGNVYLAGVKPGEHMSVFWSGVAHCDINLPDPLPADLFNGLLLPCQHKGNVAPITSPAVKPAIQEQTQRVTPTEPPTSISVNQ

SEQ ID NO: 15995 - protein, 250 aa, Escherichia coli MS 115-1; identical to SEQ ID NO: 7896

SEQ ID NO: 15996 - protein, 274 aa, Escherichia coli MS 115-1; identical to SEQ ID NO: 6489

SEQ ID NO: 15997 - protein, 219 aa, Escherichia coli MS 115-1; identical to SEQ ID NO: 6490

SEQ ID NO: 15998 - protein, 517 aa, Escherichia coli MS 115-1; identical to SEQ ID NO: 6817

SEQ ID NO: 15999 - protein, 191 aa, Escherichia coli MS 115-1
MKKSLLGLTFASLMCSAGSAVAADYKIDKEGQHAFVNFRIQHLGYSWLYGTFKDFDGTFTFDEINPAADKVNVTINTTSVDTNHAERDKHLRSADFLNTTKYPQATFTSTSVKKDGDELDITGDLTLNGVTKPVTLEAKLIGQGDDPWGGKRAGFEAEGKIKLKDFNIKTDLGPASQEVDLIISVEGVQQK

SEQ ID NO: 16000 - protein, 235 aa, Escherichia coli MS 115-1; identical to SEQ ID NO: 6404

SEQ ID NO: 16001 - protein, 729 aa, Escherichia coli MS 115-1; identical to SEQ ID NO: 6531

SEQ ID NO: 16002 - protein, 213 aa, Escherichia coli MS 115-1; identical to SEQ ID NO: 5744

SEQ ID NO: 16003 - protein, 111 aa, Escherichia coli MS 115-1; identical to SEQ ID NO: 5738

SEQ ID NO: 16004 - protein, 663 aa, Escherichia coli MS 115-1
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPSQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFSDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 16005 - protein, 169 aa, Escherichia coli MS 115-1
MKKESKKMKTILPAVLFAAFATTSAWAAESVQPLEKIAPYPQAEKGMKRQVIQLTPQEDESTLKVELLIGQTLEVDCNLHRLGGKLESKTLEGWGYDYYVFDKVSSPVSTMMACPDGKKEKKFVTAYLGDAGMLRYNSKLPIVVYTPDNVDVKYRVWKAEGKIDNAVVR

SEQ ID NO: 16006 - protein, 367 aa, Escherichia coli MS 115-1
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSVAYLQSKGKNLGTIAGRNYDDEDILKYVDVGATYYFNKNMSTYVDYKINLLDDNQFTRDAGINTDNIVALGLVYQF

SEQ ID NO: 16007 - protein, 231 aa, Escherichia coli MS 115-1; identical to SEQ ID NO: 6515

SEQ ID NO: 16008 - protein, 813 aa, Escherichia coli MS 115-1
MVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 16009 - protein, 208 aa, Escherichia coli MS 115-1; identical to SEQ ID NO: 5717

SEQ ID NO: 16010 - protein, 386 aa, Escherichia coli MS 115-1; identical to SEQ ID NO: 7993

SEQ ID NO: 16011 - protein, 353 aa, Escherichia coli MS 115-1; identical to SEQ ID NO: 15872

SEQ ID NO: 16012 - protein, 784 aa, Escherichia coli MS 115-1; identical to SEQ ID NO: 6283

SEQ ID NO: 16013 - protein, 865 aa, Escherichia coli MS 115-1
MTIKYTKNYHHLTRIATFCALLYCNSAFSAELVEYDHTFLMGQNASNIDLSRYSEGNPAIPGVYDVSVYVNDQPIINQSITFVAIEGKKNAQACITLKNLLQFHINSPDINNEKAVLLARDETLGNCLNLTEIIPQASVRYDVNDQRLDIDVPQAWVMKNYQNYVDPSLWENGINAAMLSYNLNGYHSETPGRKNESIYAAFNGGMNLGAWRLRASGNYNWMTDSGSNYDFKNRYVQRDIASLRSQLILGESYTTGETFDSVSIRGIRLYSDSRMLPPTLASFAPIIHGVANTNAKVTITQGGYKIYETTVPPGAFVIDDLSPSGYGSDLIVTIEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRTWNEDGDTDDSVYLSFTIPIEKLLGTEQRNSGFQSIDTQISSDFKGNNQLNVSSSGYSDNARVSYSVNTGYTMNKASKDLSYVGGYASYESPWGTLAGSISANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 16014 - protein, 230 aa, Escherichia coli MS 115-1
MAFSSSSIADIVISGTRVIYKSDQKSVNVRLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWSWSGSEGKASLRVANPTPYYVSFSSGDLEASGKRYPIDVKMIAPFSDEVMKVTGLNGKANSAKVHFYAINDFGGAIEGNARL

SEQ ID NO: 16015 - protein, 747 aa, Escherichia coli MS 115-1
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTVLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 16016 - protein, 266 aa, Escherichia coli MS 115-1
MAKSLFRALVALSFFAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLALSPQAIVITGGPDQIPKIKQYWGEQLKIPVIPLTSDWFERASPRIILAAQQLCNALSQVD

SEQ ID NO: 16017 - protein, 760 aa, Escherichia coli MS 115-1; identical to SEQ ID NO: 6415

SEQ ID NO: 16018 - protein, 161 aa, Escherichia coli MS 115-1; identical to SEQ ID NO: 5769

SEQ ID NO: 16019 - protein, 397 aa, Escherichia coli MS 115-1
MKIIITREYIMKRKVLAMLVPALLVAGAANAAEIYNKNGNKLDLYGKVDARHTFSDNPGDDGDETIIELGFKGETQITDQLTGYGQALTKTKASDTEGSDNTYVKLAFAGLKFGEMGSFDYGRNYGVIYDVEAWTDMLPVFGGDSYTWTDNFMAGRANGVATYRNSDFFGLVEGLNFALQYQGNNEGSNAGEDQEGTKNGHEDVRFQNGDGFGLSTSYDFDFGLSLGAAYSNSDRTNSQVALGGYHYNEYSKFAGGDTAEAWTFGAKYDANNVYLAMMYAETRNMTPYGNVGIANKTQNFEAVAQYQFDFGLRPSLAYVYSKGKDLGGNDYNNNGHQEYVDQDLVNYVEIGATYYFNKNFSTYVDYKINLLDKDDDFYDNNGIATDDVVGVGLVYQF

SEQ ID NO: 16020 - protein, 432 aa, Escherichia coli MS 115-1; identical to SEQ ID NO: 5727

SEQ ID NO: 16021 - protein, 554 aa, Escherichia coli MS 115-1
MALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLEEKYDVSTTGTGGGGGEYPLQDGFGWTNGVTLKMLDLICPKEQPCDNVPATRPTVKSATTQPSTKEAQPTP

SEQ ID NO: 16022 - protein, 207 aa, Escherichia coli MS 115-1; identical to SEQ ID NO: 5743

SEQ ID NO: 16023 - protein, 746 aa, Escherichia coli MS 115-1; identical to SEQ ID NO: 6561

SEQ ID NO: 16024 - protein, 869 aa, Escherichia coli MS 115-1
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSKQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGRKPVPFGSLVRENSTGITSMVGDDGQVYLSGAPLSGELLVQWGDGANSRCIAHYVLPKQSLQQAVTVISAVCTHPGS

SEQ ID NO: 16025 - protein, 230 aa, Escherichia coli MS 115-1; identical to SEQ ID NO: 6360

SEQ ID NO: 16026 - protein, 518 aa, Escherichia coli MS 115-1; identical to SEQ ID NO: 6358

SEQ ID NO: 16027 - protein, 236 aa, Escherichia coli MS 115-1
MTNTWNRLALLIFAVLSLLVAGELRAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSIFKLFWRPEGLPGDPLEAYQQLRWTRNSQGVQLTNPTPYYINLIQVSVNGKALSNAGVVPPKSQRQTSWCQAIAPCHVAWRAINDYGGLSAKKEQNLP

SEQ ID NO: 16028 - protein, 851 aa, Escherichia coli MS 115-1
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGVQANSGIIDDDGSLYMAGLPAKGTISVRWGEAPDQICHINYELTEQQINSAITRMDAICR

SEQ ID NO: 16029 - protein, 233 aa, Escherichia coli MS 115-1; identical to SEQ ID NO: 6411

SEQ ID NO: 16030 - protein, 362 aa, Escherichia coli MS 115-1; identical to SEQ ID NO: 6543

SEQ ID NO: 16031 - protein, 204 aa, Escherichia coli MS 115-1; identical to SEQ ID NO: 5755

SEQ ID NO: 16032 - protein, 360 aa, Escherichia coli MS 115-1; identical to SEQ ID NO: 6702

SEQ ID NO: 16033 - protein, 650 aa, Escherichia coli MS 116-1; identical to SEQ ID NO: 6393

SEQ ID NO: 16034 - protein, 897 aa, Escherichia coli MS 116-1; identical to SEQ ID NO: 6392

SEQ ID NO: 16035 - protein, 446 aa, Escherichia coli MS 116-1 [sequence omitted]

SEQ ID NO: 16036 - protein, 478 aa, Escherichia coli MS 116-1; identical to SEQ ID NO: 5711

SEQ ID NO: 16037 - protein, 386 aa, Escherichia coli MS 116-1; identical to SEQ ID NO: 7993

SEQ ID NO: 16038 - protein, 760 aa, Escherichia coli MS 116-1; identical to SEQ ID NO: 6415

SEQ ID NO: 16039 - protein, 331 aa, Escherichia coli MS 116-1
MKKPVVIGLAVVVLAAVVAGGYWWYQSRQDNGLTLYGNVDIRTVNLSFRVGGRVESLAVGEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 16040 - protein, 431 aa, Escherichia coli MS 116-1; identical to SEQ ID NO: 6791

SEQ ID NO: 16041 - protein, 802 aa, Escherichia coli MS 116-1
MAMPCAMAVEFNLNVLDKSMRDRIDISLLKEKGVIAPGEYFVSVAVNNNKISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASSYRPQDGSSSTNLNAYGTAGINAGAWRLRSDYQLNKTDSEDNHDQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISDDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTIHRMSWNDTLDERNSWGMSAGLQSDRPDNGAQVSGNYQHLSSAGEWDISGTYAASDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQLFTVVWGEQSCIIHLPERLEDTTKRLILPCH

SEQ ID NO: 16042 - protein, 242 aa, Escherichia coli MS 116-1; identical to SEQ ID NO: 6420

SEQ ID NO: 16043 - protein, 353 aa, Escherichia coli MS 116-1
MKMKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFSISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 16044 - protein, 304 aa, Escherichia coli MS 116-1
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGA

SEQ ID NO: 16045 - protein, 368 aa, Escherichia coli MS 116-1; identical to SEQ ID NO: 7693

SEQ ID NO: 16046 - protein, 774 aa, Escherichia coli MS 116-1; identical to SEQ ID NO: 7694

SEQ ID NO: 16047 - protein, 700 aa, Escherichia coli MS 116-1
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVKVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 16048 - protein, 208 aa, Escherichia coli MS 116-1; identical to SEQ ID NO: 5717

SEQ ID NO: 16049 - protein, 831 aa, Escherichia coli MS 116-1
MQELPMLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSEFVQVGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYTLAASQAYDENHHEEKRFNIFISIPFDWGDDVTTPRRQIYMSNSTTFDDQGFASNNTGLSGTVGSRDQFNYGVNLSYQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQSLTFGYEVNDIHGHNIGVVGQGSQLFIRTNEVPPSVNVAIDKQQGLSCTITFGKEIDESRNYICQ

SEQ ID NO: 16050 - protein, 239 aa, Escherichia coli MS 116-1; identical to SEQ ID NO: 6428

SEQ ID NO: 16051 - protein, 614 aa, Escherichia coli MS 116-1; identical to SEQ ID NO: 6387

SEQ ID NO: 16052 - protein, 862 aa, Escherichia coli MS 116-1; identical to SEQ ID NO: 14926

SEQ ID NO: 16053 - protein, 250 aa, Escherichia coli MS 116-1; identical to SEQ ID NO: 6361

SEQ ID NO: 16054 - protein, 274 aa, Escherichia coli MS 116-1; identical to SEQ ID NO: 6362

SEQ ID NO: 16055 - protein, 784 aa, Escherichia coli MS 116-1; identical to SEQ ID NO: 14497

SEQ ID NO: 16056 - protein, 729 aa, Escherichia coli MS 116-1; identical to SEQ ID NO: 6402

SEQ ID NO: 16057 - protein, 213 aa, Escherichia coli MS 116-1; identical to SEQ ID NO: 14910

SEQ ID NO: 16058 - protein, 231 aa, Escherichia coli MS 116-1; identical to SEQ ID NO: 6400

SEQ ID NO: 16059 - protein, 813 aa, Escherichia coli MS 116-1; identical to SEQ ID NO: 6424

SEQ ID NO: 16060 - protein, 793 aa, Escherichia coli MS 116-1; identical to SEQ ID NO: 6397

SEQ ID NO: 16061 - protein, 367 aa, Escherichia coli MS 116-1; identical to SEQ ID NO: 5789

SEQ ID NO: 16062 - protein, 192 aa, Escherichia coli MS 116-1; identical to SEQ ID NO: 8037

SEQ ID NO: 16063 - protein, 230 aa, Escherichia coli MS 116-1; identical to SEQ ID NO: 6360

SEQ ID NO: 16064 - protein, 867 aa, Escherichia coli MS 116-1; identical to SEQ ID NO: 6359

SEQ ID NO: 16065 - protein, 732 aa, Escherichia coli MS 116-1; identical to SEQ ID NO: 8819

SEQ ID NO: 16066 - protein, 236 aa, Escherichia coli MS 116-1; identical to SEQ ID NO: 6409

SEQ ID NO: 16067 - protein, 851 aa, Escherichia coli MS 116-1; identical to SEQ ID NO: 14331

SEQ ID NO: 16068 - protein, 233 aa, Escherichia coli MS 116-1; identical to SEQ ID NO: 6411

SEQ ID NO: 16069 - protein, 362 aa, Escherichia coli MS 116-1; identical to SEQ ID NO: 5809

SEQ ID NO: 16070 - protein, 204 aa, Escherichia coli MS 116-1; identical to SEQ ID NO: 5755

SEQ ID NO: 16071 - protein, 161 aa, Escherichia coli MS 116-1; identical to SEQ ID NO: 5769

SEQ ID NO: 16072 - protein, 266 aa, Escherichia coli MS 116-1; identical to SEQ ID NO: 5772

SEQ ID NO: 16073 - protein, 747 aa, Escherichia coli MS 116-1
MARSKTAQPKHSLRKIAVVVATAVSGMSVYAQAAVEPKEDTITVTAAPASQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIASAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 16074 - protein, 230 aa, Escherichia coli MS 116-1; identical to SEQ ID NO: 8021

SEQ ID NO: 16075 - protein, 865 aa, Escherichia coli MS 116-1; identical to SEQ ID NO: 14886

SEQ ID NO: 16076 - protein, 169 aa, Escherichia coli MS 116-1; identical to SEQ ID NO: 15504

SEQ ID NO: 16077 - protein, 663 aa, Escherichia coli MS 116-1; identical to SEQ ID NO: 6307

SEQ ID NO: 16078 - protein, 517 aa, Escherichia coli MS 116-1; identical to SEQ ID NO: 6406

SEQ ID NO: 16079 - protein, 191 aa, Escherichia coli MS 116-1; identical to SEQ ID NO: 5748

SEQ ID NO: 16080 - protein, 235 aa, Escherichia coli MS 116-1; identical to SEQ ID NO: 6404

SEQ ID NO: 16081 - protein, 541 aa, Escherichia coli MS 116-1
MAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVGNHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFSEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 16082 - protein, 432 aa, Escherichia coli MS 116-1; identical to SEQ ID NO: 5727

SEQ ID NO: 16083 - protein, 252 aa, Escherichia coli MS 116-1; identical to SEQ ID NO: 15541

SEQ ID NO: 16084 - protein, 834 aa, Escherichia coli MS 116-1; identical to SEQ ID NO: 7680

SEQ ID NO: 16085 - protein, 686 aa, Escherichia coli MS 116-1; identical to SEQ ID NO: 6339

SEQ ID NO: 16086 - protein, 111 aa, Escherichia coli MS 116-1; identical to SEQ ID NO: 8122

SEQ ID NO: 16087 - protein, 746 aa, Escherichia coli MS 116-1
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYPRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 16088 - protein, 122 aa, Escherichia coli MS 116-1; identical to SEQ ID NO: 5737

SEQ ID NO: 16089 - protein, 554 aa, Escherichia coli MS 116-1; identical to SEQ ID NO: 15864

SEQ ID NO: 16090 - protein, 207 aa, Escherichia coli MS 116-1; identical to SEQ ID NO: 5743

SEQ ID NO: 16091 - protein, 518 aa, Escherichia coli MS 116-1; identical to SEQ ID NO: 6358

SEQ ID NO: 16092 - protein, 541 aa, Escherichia coli MS 117-3; identical to SEQ ID NO: 6286

SEQ ID NO: 16093 - protein, 700 aa, Escherichia coli MS 117-3; identical to SEQ ID NO: 7406

SEQ ID NO: 16094 - protein, 169 aa, Escherichia coli MS 117-3; identical to SEQ ID NO: 8240

SEQ ID NO: 16095 - protein, 367 aa, Escherichia coli MS 117-3; identical to SEQ ID NO: 5777

SEQ ID NO: 16096 - protein, 219 aa, Escherichia coli MS 117-3; identical to SEQ ID NO: 6490

SEQ ID NO: 16097 - protein, 274 aa, Escherichia coli MS 117-3; identical to SEQ ID NO: 7373

SEQ ID NO: 16098 - protein, 663 aa, Escherichia coli MS 117-3; identical to SEQ ID NO: 6307

SEQ ID NO: 16099 - protein, 431 aa, Escherichia coli MS 117-3; identical to SEQ ID NO: 6791

SEQ ID NO: 16100 - protein, 819 aa, Escherichia coli MS 117-3; identical to SEQ ID NO: 7389

SEQ ID NO: 16101 - protein, 245 aa, Escherichia coli MS 117-3; identical to SEQ ID NO: 15432

SEQ ID NO: 16102 - protein, 883 aa, Escherichia coli MS 117-3; identical to SEQ ID NO: 7407

SEQ ID NO: 16103 - protein, 224 aa, Escherichia coli MS 117-3; identical to SEQ ID NO: 15902

SEQ ID NO: 16104 - protein, 518 aa, Escherichia coli MS 117-3; identical to SEQ ID NO: 6358

SEQ ID NO: 16105 - protein, 353 aa, Escherichia coli MS 117-3
MKMKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGGEDLVNYIDVGATYYFNKNMSAFVDYKINQLDSDNKLNINNDDIVAIGMTYQF

SEQ ID NO: 16106 - protein, 208 aa, Escherichia coli MS 117-3; identical to SEQ ID NO: 5717

SEQ ID NO: 16107 - protein, 614 aa, Escherichia coli MS 117-3; identical to SEQ ID NO: 6387

SEQ ID NO: 16108 - protein, 869 aa, Escherichia coli MS 117-3
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMSCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 16109 - protein, 230 aa, Escherichia coli MS 117-3; identical to SEQ ID NO: 7352

SEQ ID NO: 16110 - protein, 111 aa, Escherichia coli MS 117-3; identical to SEQ ID NO: 8676

SEQ ID NO: 16111 - protein, 236 aa, Escherichia coli MS 117-3; identical to SEQ ID NO: 6329

SEQ ID NO: 16112 - protein, 851 aa, Escherichia coli MS 117-3; identical to SEQ ID NO: 8686

SEQ ID NO: 16113 - protein, 233 aa, Escherichia coli MS 117-3; identical to SEQ ID NO: 7394

SEQ ID NO: 16114 - protein, 362 aa, Escherichia coli MS 117-3; identical to SEQ ID NO: 5809

SEQ ID NO: 16115 - protein, 204 aa, Escherichia coli MS 117-3; identical to SEQ ID NO: 5755

SEQ ID NO: 16116 - protein, 386 aa, Escherichia coli MS 117-3
MVDDVPVAQVLQALAEQEKLNLVVSPDVSGTVSLHLTDVPWKQALQTVVKSAGLITRQEGNILSVHSIAWQNDNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 16117 - protein, 331 aa, Escherichia coli MS 117-3; identical to SEQ ID NO: 6456

SEQ ID NO: 16118 - protein, 760 aa, Escherichia coli MS 117-3; identical to SEQ ID NO: 6455

SEQ ID NO: 16119 - protein, 243 aa, Escherichia coli MS 117-3; identical to SEQ ID NO: 6145

SEQ ID NO: 16120 - protein, 813 aa, Escherichia coli MS 117-3; identical to SEQ ID NO: 15877

SEQ ID NO: 16121 - protein, 231 aa, Escherichia coli MS 117-3; identical to SEQ ID NO: 6351

SEQ ID NO: 16122 - protein, 252 aa, Escherichia coli MS 117-3; identical to SEQ ID NO: 7371

SEQ ID NO: 16123 - protein, 834 aa, Escherichia coli MS 117-3; identical to SEQ ID NO: 8715

SEQ ID NO: 16124 - protein, 686 aa, Escherichia coli MS 117-3
MFWRDITLSVWRKKTTGLKTKKRLLPLVLAAALCSSPVWAEEATFTANFKDTDLKSFIETVGANLNKTIIMGQGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAGGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 16125 - protein, 122 aa, Escherichia coli MS 117-3; identical to SEQ ID NO: 5737

SEQ ID NO: 16126 - protein, 161 aa, Escherichia coli MS 117-3; identical to SEQ ID NO: 5769

SEQ ID NO: 16127 - protein, 266 aa, Escherichia coli MS 117-3; identical to SEQ ID NO: 5772

SEQ ID NO: 16128 - protein, 747 aa, Escherichia coli MS 117-3; identical to SEQ ID NO: 6486

SEQ ID NO: 16129 - protein, 230 aa, Escherichia coli MS 117-3; identical to SEQ ID NO: 7855

SEQ ID NO: 16130 - protein, 825 aa, Escherichia coli MS 117-3
MGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 16131 - protein, 784 aa, Escherichia coli MS 117-3; identical to SEQ ID NO: 6283

SEQ ID NO: 16132 - protein, 119 aa, Escherichia coli MS 117-3; identical to SEQ ID NO: 6116

SEQ ID NO: 16133 - protein, 207 aa, Escherichia coli MS 117-3; identical to SEQ ID NO: 5743

SEQ ID NO: 16134 - protein, 554 aa, Escherichia coli MS 117-3
MALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPHQLNTLRTTSIVPVDLNSLMFKMEKILARASKAAGDNAMANQYETLANARQKGIEKYMWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 16135 - protein, 213 aa, Escherichia coli MS 117-3; identical to SEQ ID NO: 5744

SEQ ID NO: 16136 - protein, 729 aa, Escherichia coli MS 117-3; identical to SEQ ID NO: 7401

SEQ ID NO: 16137 - protein, 235 aa, Escherichia coli MS 117-3; identical to SEQ ID NO: 6404

SEQ ID NO: 16138 - protein, 191 aa, Escherichia coli MS 117-3; identical to SEQ ID NO: 5748

SEQ ID NO: 16139 - protein, 517 aa, Escherichia coli MS 117-3; identical to SEQ ID NO: 6817

SEQ ID NO: 16140 - protein, 360 aa, Escherichia coli MS 117-3
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRNFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 16141 - protein, 478 aa, Escherichia coli MS 117-3; identical to SEQ ID NO: 5711

SEQ ID NO: 16142 - protein, 446 aa, Escherichia coli MS 117-3; identical to SEQ ID NO: 7378

SEQ ID NO: 16143 - protein, 368 aa, Escherichia coli MS 117-3
MNKTITALAIMMASFAANASVLPETPVPFKSGTGAIDNDTVYIGLGSAGTAWYKLDTQAKDKKWTALAAFPGAPRDQATSAFIDGNLYVFGGIGKNSKGLTQVFNDVHKYNPKTNSWVKLMSHAPMGMAGHVTFVHNGKAYVTGGVNQNIFNGYFEDLNEAGKDSATIDKINAHYFDKKAEDYFFNKFLLSFDPSTQQWSYAGESPWYGTAGAALVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 16144 - protein, 241 aa, Escherichia coli MS 117-3; identical to SEQ ID NO: 6138

SEQ ID NO: 16145 - protein, 878 aa, Escherichia coli MS 117-3
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGVQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 16146 - protein, 250 aa, Escherichia coli MS 117-3; identical to SEQ ID NO: 6317

SEQ ID NO: 16147 - protein, 861 aa, Escherichia coli MS 117-3
MSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 16148 - protein, 432 aa, Escherichia coli MS 117-3; identical to SEQ ID NO: 5727

SEQ ID NO: 16149 - protein, 746 aa, Escherichia coli MS 117-3; identical to SEQ ID NO: 7355

SEQ ID NO: 16150 - protein, 530 aa, Escherichia coli MS 117-3
MQELPMLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSAERSPHNFPK

SEQ ID NO: 16151 - protein, 213 aa, Escherichia coli MS 117-3
MVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVSRSGNGLVIKNDSANWVTISDVKANNVKVNYETIMIAPLESQSVNVKSNNANNWYLTIIDDHGNYISDKI

SEQ ID NO: 16152 - protein, 800 aa, Escherichia coli MS 119-7
MDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 16153 - protein, 230 aa, Escherichia coli MS 119-7; identical to SEQ ID NO: 8315

SEQ ID NO: 16154 - protein, 432 aa, Escherichia coli MS 119-7; identical to SEQ ID NO: 5727

SEQ ID NO: 16155 - protein, 518 aa, Escherichia coli MS 119-7; identical to SEQ ID NO: 7565

SEQ ID NO: 16156 - protein, 207 aa, Escherichia coli MS 119-7; identical to SEQ ID NO: 5743

SEQ ID NO: 16157 - protein, 554 aa, Escherichia coli MS 119-7; identical to SEQ ID NO: 16134

SEQ ID NO: 16158 - protein, 213 aa, Escherichia coli MS 119-7; identical to SEQ ID NO: 5744

SEQ ID NO: 16159 - protein, 729 aa, Escherichia coli MS 119-7; identical to SEQ ID NO: 6500

SEQ ID NO: 16160 - protein, 235 aa, Escherichia coli MS 119-7; identical to SEQ ID NO: 6404

SEQ ID NO: 16161 - protein, 191 aa, Escherichia coli MS 119-7; identical to SEQ ID NO: 5748

SEQ ID NO: 16162 - protein, 517 aa, Escherichia coli MS 119-7; identical to SEQ ID NO: 6817

SEQ ID NO: 16163 - protein, 111 aa, Escherichia coli MS 119-7; identical to SEQ ID NO: 8676

SEQ ID NO: 16164 - protein, 834 aa, Escherichia coli MS 119-7; identical to SEQ ID NO: 8715

SEQ ID NO: 16165 - protein, 252 aa, Escherichia coli MS 119-7; identical to SEQ ID NO: 7371

SEQ ID NO: 16166 - protein, 231 aa, Escherichia coli MS 119-7; identical to SEQ ID NO: 6351

SEQ ID NO: 16167 - protein, 224 aa, Escherichia coli MS 119-7; identical to SEQ ID NO: 6435

SEQ ID NO: 16168 - protein, 831 aa, Escherichia coli MS 119-7; identical to SEQ ID NO: 15893

SEQ ID NO: 16169 - protein, 784 aa, Escherichia coli MS 119-7; identical to SEQ ID NO: 6283

SEQ ID NO: 16170 - protein, 219 aa, Escherichia coli MS 119-7; identical to SEQ ID NO: 6490

SEQ ID NO: 16171 - protein, 274 aa, Escherichia coli MS 119-7; identical to SEQ ID NO: 6549

SEQ ID NO: 16172 - protein, 250 aa, Escherichia coli MS 119-7; identical to SEQ ID NO: 7896

SEQ ID NO: 16173 - protein, 861 aa, Escherichia coli MS 119-7
MSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLSDGSHPPFGAEVKNDNEQTVGLVDDDGNVYLAGVKPGEHMSVFWSGVAHCDINLPDPLPADLFNGLLLPCQHKGNVAPITSPAVKPAIQEQTQRVTPTEPPTSISVNQ

SEQ ID NO: 16174 - protein, 663 aa, Escherichia coli MS 119-7; identical to SEQ ID NO: 8669

SEQ ID NO: 16175 - protein, 828 aa, Escherichia coli MS 119-7; identical to SEQ ID NO: 7891

SEQ ID NO: 16176 - protein, 169 aa, Escherichia coli MS 119-7; identical to SEQ ID NO: 8240

SEQ ID NO: 16177 - protein, 374 aa, Escherichia coli MS 119-7
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGYATYRNTDFFGLVDGLNFAVQYQGKNGSVSGEGMTNNGRGALRQNGDGVGGSITYDYEGFGIGAAVSSSKRTDDQNFGLNGYGERYLGNGDRAETYTGGLKYDANNIYLAAQYTQTYNATRVGSLGWANKAQNFEAVAQYQFDFGLRPSVAYLQSKGKNLGVVAGRNYDDEDILKYVDVGATYYFNKNMSAYVDYKINLLDDNQFTRDAGINTDNIVALGLVYQF

SEQ ID NO: 16178 - protein, 386 aa, Escherichia coli MS 119-7; identical to SEQ ID NO: 16116

SEQ ID NO: 16179 - protein, 331 aa, Escherichia coli MS 119-7; identical to SEQ ID NO: 6551

SEQ ID NO: 16180 - protein, 431 aa, Escherichia coli MS 119-7; identical to SEQ ID NO: 6791

SEQ ID NO: 16181 - protein, 819 aa, Escherichia coli MS 119-7; identical to SEQ ID NO: 6642

SEQ ID NO: 16182 - protein, 245 aa, Escherichia coli MS 119-7; identical to SEQ ID NO: 15432

SEQ ID NO: 16183 - protein, 746 aa, Escherichia coli MS 119-7; identical to SEQ ID NO: 6296

SEQ ID NO: 16184 - protein, 682 aa, Escherichia coli MS 119-7; identical to SEQ ID NO: 15155

SEQ ID NO: 16185 - protein, 700 aa, Escherichia coli MS 119-7; identical to SEQ ID NO: 7945

SEQ ID NO: 16186 - protein, 541 aa, Escherichia coli MS 119-7
MAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQTDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 16187 - protein, 353 aa, Escherichia coli MS 119-7; identical to SEQ ID NO: 15427

SEQ ID NO: 16188 - protein, 883 aa, Escherichia coli MS 119-7; identical to SEQ ID NO: 7407

SEQ ID NO: 16189 - protein, 224 aa, Escherichia coli MS 119-7; identical to SEQ ID NO: 15902

SEQ ID NO: 16190 - protein, 446 aa, Escherichia coli MS 119-7; identical to SEQ ID NO: 6459

SEQ ID NO: 16191 - protein, 204 aa, Escherichia coli MS 119-7; identical to SEQ ID NO: 5755

SEQ ID NO: 16192 - protein, 362 aa, Escherichia coli MS 119-7; identical to SEQ ID NO: 5809

SEQ ID NO: 16193 - protein, 208 aa, Escherichia coli MS 119-7; identical to SEQ ID NO: 5717

SEQ ID NO: 16194 - protein, 241 aa, Escherichia coli MS 119-7; identical to SEQ ID NO: 6134

SEQ ID NO: 16195 - protein, 856 aa, Escherichia coli MS 119-7
MAGFFVRLFVACAFAAQTPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNNHYAYLNLQSGLNIGAWRLRDNTSWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPERQQQLLTQLSAECR

SEQ ID NO: 16196 - protein, 816 aa, Escherichia coli MS 119-7
CLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDAKGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 16197 - protein, 686 aa, Escherichia coli MS 119-7; identical to SEQ ID NO: 6453

SEQ ID NO: 16198 - protein, 161 aa, Escherichia coli MS 119-7; identical to SEQ ID NO: 5769

SEQ ID NO: 16199 - protein, 266 aa, Escherichia coli MS 119-7; identical to SEQ ID NO: 5772

SEQ ID NO: 16200 - protein, 747 aa, Escherichia coli MS 119-7; identical to SEQ ID NO: 6343

SEQ ID NO: 16201 - protein, 236 aa, Escherichia coli MS 119-7
MTNTWNRLALLIFAVLSLLVAGELQAGVVVGGTRFIFPADKESIAILLTNTSQESWLINSKINRPTRWAGGEVSTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAIAPCHVAWRAINDYGGLSAKKEQNLP

SEQ ID NO: 16202 - protein, 851 aa, Escherichia coli MS 119-7; identical to SEQ ID NO: 9233

SEQ ID NO: 16203 - protein, 233 aa, Escherichia coli MS 119-7; identical to SEQ ID NO: 6327

SEQ ID NO: 16204 - protein, 130 aa, Escherichia coli MS 119-7; identical to SEQ ID NO: 7726

SEQ ID NO: 16205 - protein, 760 aa, Escherichia coli MS 119-7
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVTTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 16206 - protein, 614 aa, Escherichia coli MS 119-7; identical to SEQ ID NO: 7971

SEQ ID NO: 16207 - protein, 243 aa, Escherichia coli MS 119-7; identical to SEQ ID NO: 15477

SEQ ID NO: 16208 - protein, 478 aa, Escherichia coli MS 119-7; identical to SEQ ID NO: 5711

SEQ ID NO: 16209 - protein, 244 aa, Escherichia coli MS 119-7; identical to SEQ ID NO: 6111

SEQ ID NO: 16210 - protein, 360 aa, Escherichia coli MS 119-7; identical to SEQ ID NO: 6645

SEQ ID NO: 16211 - protein, 836 aa, Escherichia coli MS 119-7; identical to SEQ ID NO: 15043

SEQ ID NO: 16212 - protein, 688 aa, Escherichia coli MS 119-7
MLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARLSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 16213 - protein, 733 aa, Escherichia coli MS 119-7; identical to SEQ ID NO: 6078

SEQ ID NO: 16214 - protein, 843 aa, Escherichia coli MS 119-7
MFVMAMCSICHANSGVERTYSFDSTLLNSDAKNVDLTLFEAGAQLPGTYHVDIILNDSIVESREMFFHTAQDSEGKTYLKTCLTRDMLIRYGVKTEMYPELFHTSGKKNNVGAEEDCADLSVIPHATEMFQFASQQLRLGIPQAALRPPLRGIAPEALWDDGITAFLMNWQANVSQSEYRKYGHSVSDNFWASIEPGFNLGPWRVRNLMTWSKSSDQPGNWETVYTRAERGVNNMKSRLTLGDDYTPSDIFDSLPFRGIMLGSDESMVPYNQRAFAPVVRGVARTQARIEVRQNGYLIQSQTVAPGAFALTDLPLTSSGGDLQVTVLESDGTTQVFTVPFTTPAVALREGYMKYNVTMGQYRPSDSAVERSLLGQLTSIYGLPYGLTVFGGVQMAEHYLAGALGGGWSLGGLGAISVDSIYARSQLKGKDNEAGNTWRIRYNKSFELTDTSFTVASYQYSSAGYHSLPNVLDSYRDSRTGSFDHSENKLRRTTLNLTQPLGVLGSASLYGSRDEYRGNRAKQDSVGVTLGGSWNNISWSVNGSRNRNFGLYKGQEGKTENRISLWMSVPLERWLGNAANDIRATTQILKSSGQKTRYEVGMNGNAFDRRLYWDISEEMVPGSENSSDNSRLNLRWQGTYGELTGMYGYSSHMRQISAGISGGMIAHSEGITLGQKTGDTTALVVAPGVSGASVEGWPGVKTDYRGYTLAGYMSAYQENVITMDPSTFKENAEVVRTDTKVIPTKGAVVKANFETRVGARTLITLTRHDGSPVPFGSVVTLEEEKESHPSVGVMGNNGEVYMSGLPKKGNLKVVWGEKNQCNASYQLPEQKGTAGIFLARSVCM

SEQ ID NO: 16215 - protein, 188 aa, Escherichia coli MS 119-7
MLVQSEVLAEDRKGKAPFVVTPPLFRLDGLQSSRLRIVRTGGVFPEDRESLQWLCVKGIPPKSGDRWADDKNRNKADDRVSLQMNFSVNSCIKLIIRPDSVKGHPEDVAGNVVWQKTGNKLIGTNPTPFYINLSELSVGGKKVESRHYIAPFSTYEYDIPVSTAGNVYWKVITDYGGNSKQFEAKPKS

SEQ ID NO: 16216 - protein, 230 aa, Escherichia coli MS 119-7; identical to SEQ ID NO: 7855

SEQ ID NO: 16217 - protein, 230 aa, Escherichia coli MS 124-1; identical to SEQ ID NO: 6294

SEQ ID NO: 16218 - protein, 820 aa, Escherichia coli MS 124-1; identical to SEQ ID NO: 12991

SEQ ID NO: 16219 - protein, 365 aa, Escherichia coli MS 124-1; identical to SEQ ID NO: 7354

SEQ ID NO: 16220 - protein, 771 aa, Escherichia coli MS 124-1
MVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYSGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGI

SEQ ID NO: 16221 - protein, 231 aa, Escherichia coli MS 124-1; identical to SEQ ID NO: 13029

SEQ ID NO: 16222 - protein, 252 aa, Escherichia coli MS 124-1; identical to SEQ ID NO: 7371

SEQ ID NO: 16223 - protein, 603 aa, Escherichia coli MS 124-1
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQDEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNS

SEQ ID NO: 16224 - protein, 353 aa, Escherichia coli MS 124-1; identical to SEQ ID NO: 15872

SEQ ID NO: 16225 - protein, 746 aa, Escherichia coli MS 124-1; identical to SEQ ID NO: 7355

SEQ ID NO: 16226 - protein, 386 aa, Escherichia coli MS 124-1; identical to SEQ ID NO: 7908

SEQ ID NO: 16227 - protein, 236 aa, Escherichia coli MS 124-1
MTNTWNRLALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAIRSVFKLFWRPEGLPGDPLEAYQQLRWTWNSQGVQLTNPTPYYINLIQVSVNGKALSNAGVVPPKSQRQTSWCHAIAPCHVAWRAINDYGGLSAKKEQNLP

SEQ ID NO: 16228 - protein, 851 aa, Escherichia coli MS 124-1; identical to SEQ ID NO: 13000

SEQ ID NO: 16229 - protein, 233 aa, Escherichia coli MS 124-1; identical to SEQ ID NO: 6327

SEQ ID NO: 16230 - protein, 146 aa, Escherichia coli MS 124-1
MVQLTVPTCKKLNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 16231 - protein, 204 aa, Escherichia coli MS 124-1; identical to SEQ ID NO: 5755

SEQ ID NO: 16232 - protein, 446 aa, Escherichia coli MS 124-1; identical to SEQ ID NO: 6459

SEQ ID NO: 16233 - protein, 237 aa, Escherichia coli MS 124-1; identical to SEQ ID NO: 6313

SEQ ID NO: 16234 - protein, 478 aa, Escherichia coli MS 124-1; identical to SEQ ID NO: 13185

SEQ ID NO: 16235 - protein, 518 aa, Escherichia coli MS 124-1; identical to SEQ ID NO: 6358

SEQ ID NO: 16236 - protein, 111 aa, Escherichia coli MS 124-1; identical to SEQ ID NO: 7885

SEQ ID NO: 16237 - protein, 219 aa, Escherichia coli MS 124-1; identical to SEQ ID NO: 6490

SEQ ID NO: 16238 - protein, 208 aa, Escherichia coli MS 124-1; identical to SEQ ID NO: 5717

SEQ ID NO: 16239 - protein, 331 aa, Escherichia coli MS 124-1
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLILAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGNEAGHE

SEQ ID NO: 16240 - protein, 733 aa, Escherichia coli MS 124-1
MAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLMNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 16241 - protein, 230 aa, Escherichia coli MS 124-1; identical to SEQ ID NO: 7855

SEQ ID NO: 16242 - protein, 765 aa, Escherichia coli MS 124-1
MQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLDTEQRTSGFQSIDTQMSSDFKGNNQLNVSSSGYSDNARLSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIE

SEQ ID NO: 16243 - protein, 774 aa, Escherichia coli MS 124-1
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYNDNNKGIYAGQPRTLYMQGSLKF

SEQ ID NO: 16244 - protein, 686 aa, Escherichia coli MS 124-1; identical to SEQ ID NO: 6453

SEQ ID NO: 16245 - protein, 682 aa, Escherichia coli MS 124-1; identical to SEQ ID NO: 6220

SEQ ID NO: 16246 - protein, 673 aa, Escherichia coli MS 124-1; identical to SEQ ID NO: 6170

SEQ ID NO: 16247 - protein, 122 aa, Escherichia coli MS 124-1; identical to SEQ ID NO: 5737

SEQ ID NO: 16248 - protein, 432 aa, Escherichia coli MS 124-1; identical to SEQ ID NO: 5727

SEQ ID NO: 16249 - protein, 819 aa, Escherichia coli MS 124-1
MLSLAGVPVYAVDFNTDVLDAADRQNIDFSRFSRAGYIMPGQYQMEIRVNGQDISPSAFQIAFLEPPFSDSDNEKPLPEPCLTPEIVSRMGLTEASQEKVTYWNNGQCADFRQLSGVEIRPNPAEGMLYINMPQAWLEYSDASWLPPSRWDNGIPGLLFDYNINGTVNKPHQGKQSQSLNYNGTAGANFGAWRLRADYQGNLNHTTGSAQGTDSQFTWSRFYMYRAIPRWRANLTLGENYINSEIFSSWRYTGASLESDDRMLPPKLRGYAPQVSGIADTNARVVISQQGRILYDSTVPAGPFTIQDLDSSVRGRLDVEVIEQDGRKKTFQVDTAYVPYLTRPGQVRYKLVSGRSRTYEHTMEGPVFAAGEASWGISNTWSLYGGSIVAGDYNALAVGLGRDLSKFGTVSADVTQSVARIPGYDTKQGKSWRLSYSKRFDEVNTDITFAGYRFSERNYMTMDQYLNARYRNDFTGREKELYTVTLNKNFEDWKASVNLQYSHQTYWDRRTSDYYTLSVNRYFDAFSFKNIALGISASRSKYLNRDNDSAFVRLSVPWGTGTASYSGSMSNDRYTNTVGYSDTLNNGLSSYSLNAGVNSGGGQPSQRQMSAYYNHNGSLTNLSASFSAVENGYSSFGMSASGGATVTMKGAALHAGGMNGGTRLLVDTDGVGGVPVDGGRVYTNRWGIGVVTDVSSYYRNTTSVDLNKLPEDMEATRSVVESVLTEGAIGYREFEVLKGSRLFAVLRMSDNSYPPFGASVTNAKGRELGMVADSGLAWLSGVNPGETLNVGWDGRTQCVVDIPAHPDPAQQLLLPCRQVK

SEQ ID NO: 16250 - protein, 267 aa, Escherichia coli MS 124-1; identical to SEQ ID NO: 15862

SEQ ID NO: 16251 - protein, 883 aa, Escherichia coli MS 124-1; identical to SEQ ID NO: 10607

SEQ ID NO: 16252 - protein, 224 aa, Escherichia coli MS 124-1; identical to SEQ ID NO: 15902

SEQ ID NO: 16253 - protein, 250 aa, Escherichia coli MS 124-1; identical to SEQ ID NO: 6317

SEQ ID NO: 16254 - protein, 862 aa, Escherichia coli MS 124-1
MSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEEFSGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRLQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 16255 - protein, 410 aa, Escherichia coli MS 124-1
MAACTLLYTGNTEARTYSFDASMLKGGGKGVDLTLFEEGAQLPGIYPVDIILNGSRVDSRDMAFRTEKDAEGKTYLKTCLTREMLARYGVMTEEYPELFHGDDGKEADACAELSVIPQATETYQFASQQLLLSIPQVALRPPLRGIAPEALWDDGIPAFLLNWQANTSRSEYRGYGKSVTDNYWVTLEPGINLGPWRVRNLTTWNRSSGQPGQWESAYIRAERGINSLRSRLTLGEDYTPSDIFDSVPFRGVMLGSDESMVPYNQREFAPVVRGIARTQARIEVRQNGYLIDSRTVAPGAFALTDLPLTGSGGDLQVTVQESDGTAQVLTVPYTTPAIALREGYMKYSIAGGEYRSSDDAVEHSPLGQMSVMYGLPWGLTAFGGGTDVIALSVSGSGAGMVNGQTGGGVG

SEQ ID NO: 16256 - protein, 255 aa, Escherichia coli MS 124-1
MKIRHLAALVGILAGLPASGVMAAGNQESTKTTSKVFSLHLGTTRVIYNLDSSGASLTVMNDLDYPMLVQSEVLAENQKDPAPFVVTPPLFRLDALQSSRLRIVRTGGGFPEDRESLQWLCVKGIPPKHDDRWAEEKGADKKKADKATLQVNLSVSSCVKLFVRPPAVKGRPEDAGGKVEWTKSGNKLKGNNPTPFYINISELSVGGKEVKEHRYISPYSSYEYEIPSGASGKVSWTVITDYGGKSKPFESELKS

SEQ ID NO: 16257 - protein, 235 aa, Escherichia coli MS 124-1; identical to SEQ ID NO: 6404

SEQ ID NO: 16258 - protein, 191 aa, Escherichia coli MS 124-1; identical to SEQ ID NO: 5748

SEQ ID NO: 16259 - protein, 517 aa, Escherichia coli MS 124-1; identical to SEQ ID NO: 6817

SEQ ID NO: 16260 - protein, 784 aa, Escherichia coli MS 124-1; identical to SEQ ID NO: 12980

SEQ ID NO: 16261 - protein, 368 aa, Escherichia coli MS 124-1
MNKTITALAIMMASFAANASVLPETPVPFKSGTGAIDNDTVYIGLGSTGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 16262 - protein, 241 aa, Escherichia coli MS 124-1
MSNKNVNVRKSQEITFCLLAGILIFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 16263 - protein, 856 aa, Escherichia coli MS 124-1
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 16264 - protein, 831 aa, Escherichia coli MS 124-1
MQELPMLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWGEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKHSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLTFGYEVNDIHGHNIGVVGQGSQLFIRTNEIPPSVNVAIDKQQGLSCTITFGKEIDESRNYICQ

SEQ ID NO: 16265 - protein, 239 aa, Escherichia coli MS 124-1
MAAIPWRPFNLRGIKMKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKSAMQNRIKLFYRPAGIAPVNKATFKKLLVNRSGNGLVIKNDSANWVTISDVKANNVKVNYETIMIAPLESQSVNVKSNNANNWYLTIIDDHGNYISDKI

SEQ ID NO: 16266 - protein, 245 aa, Escherichia coli MS 124-1; identical to SEQ ID NO: 15432

SEQ ID NO: 16267 - protein, 819 aa, Escherichia coli MS 124-1
MDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTTGINAGAWRLRSDYQLNQTDSDDNHEQSGGISRTYLFRPLPQLGSKLTLGETDFSSNIFDGFSYTGAALASDERMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 16268 - protein, 431 aa, Escherichia coli MS 124-1; identical to SEQ ID NO: 6791

SEQ ID NO: 16269 - protein, 266 aa, Escherichia coli MS 124-1; identical to SEQ ID NO: 5772

SEQ ID NO: 16270 - protein, 161 aa, Escherichia coli MS 124-1; identical to SEQ ID NO: 5769

SEQ ID NO: 16271 - protein, 650 aa, Escherichia coli MS 124-1
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRHAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYHSLSKEKYTRYRQEQQQRIDGKSKALVGSEDLPVLDENTFNSHAPAPSSR

SEQ ID NO: 16272 - protein, 794 aa, Escherichia coli MS 124-1
MKLNIFTKSMIGMGLVCSALPALAMEAWNNQQGGNKYQVIFDGKIYENAWWVASSNCPGDAKSNDASNPWRYVRAATATEISETSNPQSCTSAPQPSPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGGAVTPVDPTPETPVTPTPDNNEPSTPADSGNDYSLQTWSGQEGSEIYHVIFNGNVYKNAWWVGSKDCPRGTSAENSNNPWRLVRTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLKVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 16273 - protein, 554 aa, Escherichia coli MS 124-1
MALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPHQLNTLRTTSIVPVDLNSLMFKMEKILARASKAAGDNAMANQYETLANARQKGIEKYMWNDQQGWYADYDLKSYKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 16274 - protein, 207 aa, Escherichia coli MS 124-1; identical to SEQ ID NO: 13010

SEQ ID NO: 16275 - protein, 243 aa, Escherichia coli MS 124-1; identical to SEQ ID NO: 6145

SEQ ID NO: 16276 - protein, 213 aa, Escherichia coli MS 124-1; identical to SEQ ID NO: 5744

SEQ ID NO: 16277 - protein, 729 aa, Escherichia coli MS 124-1; identical to SEQ ID NO: 6531

SEQ ID NO: 16278 - protein, 700 aa, Escherichia coli MS 124-1; identical to SEQ ID NO: 13012

SEQ ID NO: 16279 - protein, 722 aa, Escherichia coli MS 124-1
MRINKILWSLTVLLVGLNSQVSVAKSSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSDEGATRRANFSLSGPLAGNALTTRLYGNLNKTDADSWDINSPVGTKNAAGHEGVRNKDINGVVSWKLNPQQILDFEAGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDSDISGSAADRSSKNHSQISALYIEDNIEPVPGTNIIPGVRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 16280 - protein, 663 aa, Escherichia coli MS 124-1
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSFNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 16281 - protein, 367 aa, Escherichia coli MS 124-1; identical to SEQ ID NO: 5784

SEQ ID NO: 16282 - protein, 360 aa, Escherichia coli MS 124-1; identical to SEQ ID NO: 6702

SEQ ID NO: 16283 - protein, 733 aa, Escherichia coli MS 124-1; identical to SEQ ID NO: 15423

SEQ ID NO: 16284 - protein, 244 aa, Escherichia coli MS 124-1; identical to SEQ ID NO: 6111

SEQ ID NO: 16285 - protein, 735 aa, Escherichia coli MS 124-1
MVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNITSVDLKRLPDDVEATRSVVESALTEGAIGYRKFSVLKGKRLFAILRLADGSQPPFGASVTSEKGRELGMVADEGLAWLSGVTPGETLSVNWDEKIQCQVNVPETAISDQQLLLPCTPQK

SEQ ID NO: 16286 - protein, 121 aa, Escherichia coli MS 124-1; identical to SEQ ID NO: 6175

SEQ ID NO: 16287 - protein, 729 aa, Escherichia coli MS 124-1; identical to SEQ ID NO: 12984

SEQ ID NO: 16288 - protein, 169 aa, Escherichia coli MS 124-1; identical to SEQ ID NO: 8240

SEQ ID NO: 16289 - protein, 828 aa, Escherichia coli MS 124-1; identical to SEQ ID NO: 6558

SEQ ID NO: 16290 - protein, 274 aa, Escherichia coli MS 145-7; identical to SEQ ID NO: 6316

SEQ ID NO: 16291 - protein, 250 aa, Escherichia coli MS 145-7; identical to SEQ ID NO: 7896

SEQ ID NO: 16292 - protein, 774 aa, Escherichia coli MS 145-7; identical to SEQ ID NO: 6673

SEQ ID NO: 16293 - protein, 831 aa, Escherichia coli MS 145-7; identical to SEQ ID NO: 15893

SEQ ID NO: 16294 - protein, 213 aa, Escherichia coli MS 145-7; identical to SEQ ID NO: 12304

SEQ ID NO: 16295 - protein, 663 aa, Escherichia coli MS 145-7; identical to SEQ ID NO: 8669

SEQ ID NO: 16296 - protein, 828 aa, Escherichia coli MS 145-7; identical to SEQ ID NO: 6558

SEQ ID NO: 16297 - protein, 169 aa, Escherichia coli MS 145-7; identical to SEQ ID NO: 8240

SEQ ID NO: 16298 - protein, 363 aa, Escherichia coli MS 145-7; identical to SEQ ID NO: 7893

SEQ ID NO: 16299 - protein, 219 aa, Escherichia coli MS 145-7; identical to SEQ ID NO: 6490

SEQ ID NO: 16300 - protein, 111 aa, Escherichia coli MS 145-7; identical to SEQ ID NO: 8676

SEQ ID NO: 16301 - protein, 834 aa, Escherichia coli MS 145-7; identical to SEQ ID NO: 8715

SEQ ID NO: 16302 - protein, 252 aa, Escherichia coli MS 145-7; identical to SEQ ID NO: 7371

SEQ ID NO: 16303 - protein, 231 aa, Escherichia coli MS 145-7; identical to SEQ ID NO: 6351

SEQ ID NO: 16304 - protein, 721 aa, Escherichia coli MS 145-7
MDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 16305 - protein, 360 aa, Escherichia coli MS 145-7; identical to SEQ ID NO: 6702

SEQ ID NO: 16306 - protein, 686 aa, Escherichia coli MS 145-7; identical to SEQ ID NO: 6453

SEQ ID NO: 16307 - protein, 700 aa, Escherichia coli MS 145-7; identical to SEQ ID NO: 7945

SEQ ID NO: 16308 - protein, 122 aa, Escherichia coli MS 145-7; identical to SEQ ID NO: 5737

SEQ ID NO: 16309 - protein, 554 aa, Escherichia coli MS 145-7; identical to SEQ ID NO: 15864

SEQ ID NO: 16310 - protein, 207 aa, Escherichia coli MS 145-7; identical to SEQ ID NO: 5743

SEQ ID NO: 16311 - protein, 518 aa, Escherichia coli MS 145-7; identical to SEQ ID NO: 7565

SEQ ID NO: 16312 - protein, 386 aa, Escherichia coli MS 145-7; identical to SEQ ID NO: 7993

SEQ ID NO: 16313 - protein, 191 aa, Escherichia coli MS 145-7; identical to SEQ ID NO: 5748

SEQ ID NO: 16314 - protein, 517 aa, Escherichia coli MS 145-7; identical to SEQ ID NO: 6406

SEQ ID NO: 16315 - protein, 236 aa, Escherichia coli MS 145-7; identical to SEQ ID NO: 6329

SEQ ID NO: 16316 - protein, 233 aa, Escherichia coli MS 145-7
MKTCITKGIVTVSLTAILLSCSSAWAAGKGGIGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLGEAPAKLSCTSSADMVTVSNPTPYFITLTDLKIGGKVVKNQMISPFDKYQFSLPKGAKNSSVTYRTINDYGAETPQLNCKS

SEQ ID NO: 16317 - protein, 362 aa, Escherichia coli MS 145-7; identical to SEQ ID NO: 5809

SEQ ID NO: 16318 - protein, 432 aa, Escherichia coli MS 145-7; identical to SEQ ID NO: 5727

SEQ ID NO: 16319 - protein, 204 aa, Escherichia coli MS 145-7; identical to SEQ ID NO: 5755

SEQ ID NO: 16320 - protein, 746 aa, Escherichia coli MS 145-7
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITQKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGANTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 16321 - protein, 368 aa, Escherichia coli MS 145-7; identical to SEQ ID NO: 8785

SEQ ID NO: 16322 - protein, 241 aa, Escherichia coli MS 145-7; identical to SEQ ID NO: 6130

SEQ ID NO: 16323 - protein, 856 aa, Escherichia coli MS 145-7
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGVQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCIANYQLPPESQQQLLTQLSAECR

SEQ ID NO: 16324 - protein, 243 aa, Escherichia coli MS 145-7; identical to SEQ ID NO: 6145

SEQ ID NO: 16325 - protein, 446 aa, Escherichia coli MS 145-7; identical to SEQ ID NO: 6459

SEQ ID NO: 16326 - protein, 478 aa, Escherichia coli MS 145-7; identical to SEQ ID NO: 8712

SEQ ID NO: 16327 - protein, 784 aa, Escherichia coli MS 145-7; identical to SEQ ID NO: 6283

SEQ ID NO: 16328 - protein, 825 aa, Escherichia coli MS 145-7
MGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGSLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 16329 - protein, 230 aa, Escherichia coli MS 145-7; identical to SEQ ID NO: 7855

SEQ ID NO: 16330 - protein, 747 aa, Escherichia coli MS 145-7; identical to SEQ ID NO: 6343

SEQ ID NO: 16331 - protein, 266 aa, Escherichia coli MS 145-7; identical to SEQ ID NO: 9078

SEQ ID NO: 16332 - protein, 161 aa, Escherichia coli MS 145-7; identical to SEQ ID NO: 5769

SEQ ID NO: 16333 - protein, 213 aa, Escherichia coli MS 145-7
MTKMSRYALITALAMFLAGCVGQREPAPVEEVKPAPEQPAEPQQPVPTVPSVPTIPQQPSPIEHEDQTAPPAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 16334 - protein, 729 aa, Escherichia coli MS 145-7
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTQGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 16335 - protein, 224 aa, Escherichia coli MS 145-7; identical to SEQ ID NO: 10987

SEQ ID NO: 16336 - protein, 883 aa, Escherichia coli MS 145-7
MTAFRAAFKAYRMHQVLILPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLQDRLADASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 16337 - protein, 351 aa, Escherichia coli MS 145-7
MSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRY

SEQ ID NO: 16338 - protein, 380 aa, Escherichia coli MS 145-7
MNIYRAVTSFFNNSSKKGLTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNNQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGMVYQF

SEQ ID NO: 16339 - protein, 614 aa, Escherichia coli MS 145-7; identical to SEQ ID NO: 8722

SEQ ID NO: 16340 - protein, 869 aa, Escherichia coli MS 145-7; identical to SEQ ID NO: 8702

SEQ ID NO: 16341 - protein, 230 aa, Escherichia coli MS 145-7; identical to SEQ ID NO: 6360

SEQ ID NO: 16342 - protein, 120 aa, Escherichia coli MS 145-7; identical to SEQ ID NO: 5917

SEQ ID NO: 16343 - protein, 245 aa, Escherichia coli MS 145-7; identical to SEQ ID NO: 15432

SEQ ID NO: 16344 - protein, 819 aa, Escherichia coli MS 145-7
MDTVNIYRLSLVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQNFTVVWGDSQHCSLHLPEHMEDTANRLILPCH

SEQ ID NO: 16345 - protein, 431 aa, Escherichia coli MS 145-7; identical to SEQ ID NO: 6791

SEQ ID NO: 16346 - protein, 208 aa, Escherichia coli MS 145-7; identical to SEQ ID NO: 5717

SEQ ID NO: 16347 - protein, 353 aa, Escherichia coli MS 145-7; identical to SEQ ID NO: 15514

SEQ ID NO: 16348 - protein, 331 aa, Escherichia coli MS 145-7; identical to SEQ ID NO: 6456

SEQ ID NO: 16349 - protein, 541 aa, Escherichia coli MS 145-7; identical to SEQ ID NO: 6286

SEQ ID NO: 16350 - protein, 760 aa, Escherichia coli MS 145-7
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDARRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 16351 - protein, 235 aa, Escherichia coli MS 145-7
MIAMQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFNGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 16352 - protein, 322 aa, Escherichia coli MS 145-7
PTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQ

SEQ ID NO: 16353 - protein, 831 aa, Escherichia coli MS 146-1
MQELPMLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYSWDIGVFRLDFSVPQAWVEELESGYVPPENWERGINAFYTSYYVSQYYSDYKASGNNKSTYVRFNSGLNLLEWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSNYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNWRRISYTLAASQAYDENHHEEKRFNIFISIPFDWGDDVTTPRRQIYMSNSTTFDDQGFASNNTGLSGTVGSRDQFNYGVNLSYQHQGNETTAGANLTWNAPVATVNGSYSQSSTYRQAGASVSGGIVAWSGSVNLANRLSETFAVMNAPGIKDAYVNGQKYRTTNRNGVVIYDGMTPYQENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 16354 - protein, 368 aa, Escherichia coli MS 146-1; identical to SEQ ID NO: 6380

SEQ ID NO: 16355 - protein, 774 aa, Escherichia coli MS 146-1; identical to SEQ ID NO: 6382

SEQ ID NO: 16356 - protein, 362 aa, Escherichia coli MS 146-1; identical to SEQ ID NO: 5809

SEQ ID NO: 16357 - protein, 233 aa, Escherichia coli MS 146-1; identical to SEQ ID NO: 6411

SEQ ID NO: 16358 - protein, 851 aa, Escherichia coli MS 146-1
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYAISYRENRIALDAASLKRNVDLENAVVNVVPTKGALVLAEFNAHAGARVLMKTSKQGIPLRFGAIATLDGVQANSGIIDDDGSLYMAGLPAKGTISVRWGEAPDQICHINYELTEQQINSAITRMDAICR

SEQ ID NO: 16359 - protein, 236 aa, Escherichia coli MS 146-1; identical to SEQ ID NO: 6409

SEQ ID NO: 16360 - protein, 353 aa, Escherichia coli MS 146-1; identical to SEQ ID NO: 15514

SEQ ID NO: 16361 - protein, 128 aa, Escherichia coli MS 146-1
MKLMRYLNTKNIIAAGVLLSCMSSIAWGAIIPDRTRIIMNESDKGEALKLTNQSKNLPYLAQTWIEDTKGNKSRDFIVTVPPMVRLNPSEQIQIRMITQEKIAQLPKDRETLFYFNVREIPPKTDKKM

SEQ ID NO: 16362 - protein, 789 aa, Escherichia coli MS 146-1
MKTFNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNHIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 16363 - protein, 360 aa, Escherichia coli MS 146-1; identical to SEQ ID NO: 6702

SEQ ID NO: 16364 - protein, 897 aa, Escherichia coli MS 146-1; identical to SEQ ID NO: 15549

SEQ ID NO: 16365 - protein, 650 aa, Escherichia coli MS 146-1; identical to SEQ ID NO: 6393

SEQ ID NO: 16366 - protein, 663 aa, Escherichia coli MS 146-1; identical to SEQ ID NO: 6307

SEQ ID NO: 16367 - protein, 729 aa, Escherichia coli MS 146-1; identical to SEQ ID NO: 6402

SEQ ID NO: 16368 - protein, 213 aa, Escherichia coli MS 146-1; identical to SEQ ID NO: 5744

SEQ ID NO: 16369 - protein, 231 aa, Escherichia coli MS 146-1; identical to SEQ ID NO: 6400

SEQ ID NO: 16370 - protein, 813 aa, Escherichia coli MS 146-1
MVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQQLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVSAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGSVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 16371 - protein, 793 aa, Escherichia coli MS 146-1
MLKKTLLAYTIGFAFSPPANADGIEIAAVDFDRETLKSLGVDPNISHYFSRSARFLPGEYSLIVSVNGEKKGNIATRFDENGDICLDQAFLQQAGLKIPSEEKNGCYDYILSYPGTTITPLPNQEALDIIVSPQAIIPIGLDLTNAATGGTAALLNYSLMSSRAEFSNGSSDYSQAALEGGININDWMLRSHQFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRGDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFAIAKMDNNIAGVRITSQAGPVWTDFRGNAVIPSIQPWRTSGVEIDTASLPKNVDIGNGTKMIKQGRGAVGKVGFSAITQRRALLNITLSDGKKLPRGVAIEDSEGNYLTTSVDDGVVFLNNIKPDMVLDIKDEQQSCRIHLTFPEDAPKDVFYETATGECQ

SEQ ID NO: 16372 - protein, 517 aa, Escherichia coli MS 146-1; identical to SEQ ID NO: 6406

SEQ ID NO: 16373 - protein, 191 aa, Escherichia coli MS 146-1; identical to SEQ ID NO: 5748

SEQ ID NO: 16374 - protein, 235 aa, Escherichia coli MS 146-1; identical to SEQ ID NO: 6404

SEQ ID NO: 16375 - protein, 446 aa, Escherichia coli MS 146-1 [sequence omitted]

SEQ ID NO: 16376 - protein, 478 aa, Escherichia coli MS 146-1; identical to SEQ ID NO: 5711

SEQ ID NO: 16377 - protein, 614 aa, Escherichia coli MS 146-1; identical to SEQ ID NO: 6387

SEQ ID NO: 16378 - protein, 432 aa, Escherichia coli MS 146-1; identical to SEQ ID NO: 5727

SEQ ID NO: 16379 - protein, 700 aa, Escherichia coli MS 146-1; identical to SEQ ID NO: 6388

SEQ ID NO: 16380 - protein, 221 aa, Escherichia coli MS 146-1; identical to SEQ ID NO: 8014

SEQ ID NO: 16381 - protein, 122 aa, Escherichia coli MS 146-1; identical to SEQ ID NO: 5737

SEQ ID NO: 16382 - protein, 386 aa, Escherichia coli MS 146-1; identical to SEQ ID NO: 7993

SEQ ID NO: 16383 - protein, 331 aa, Escherichia coli MS 146-1; identical to SEQ ID NO: 6551

SEQ ID NO: 16384 - protein, 733 aa, Escherichia coli MS 146-1; identical to SEQ ID NO: 16240

SEQ ID NO: 16385 - protein, 204 aa, Escherichia coli MS 146-1; identical to SEQ ID NO: 5755

SEQ ID NO: 16386 - protein, 865 aa, Escherichia coli MS 146-1; identical to SEQ ID NO: 6375

SEQ ID NO: 16387 - protein, 230 aa, Escherichia coli MS 146-1; identical to SEQ ID NO: 8021

SEQ ID NO: 16388 - protein, 747 aa, Escherichia coli MS 146-1; identical to SEQ ID NO: 6343

SEQ ID NO: 16389 - protein, 266 aa, Escherichia coli MS 146-1; identical to SEQ ID NO: 5772

SEQ ID NO: 16390 - protein, 161 aa, Escherichia coli MS 146-1; identical to SEQ ID NO: 5769

SEQ ID NO: 16391 - protein, 241 aa, Escherichia coli MS 146-1; identical to SEQ ID NO: 6143

SEQ ID NO: 16392 - protein, 856 aa, Escherichia coli MS 146-1
MAGFFVRLVVACAFAAQAPLSSADLYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 16393 - protein, 169 aa, Escherichia coli MS 146-1; identical to SEQ ID NO: 15504

SEQ ID NO: 16394 - protein, 541 aa, Escherichia coli MS 146-1; identical to SEQ ID NO: 6754

SEQ ID NO: 16395 - protein, 594 aa, Escherichia coli MS 146-1
MTCLFAPSLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISDDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTIHRMSWNDTLDERNSWGMSAGLQSDRPDNGAQVSGNYQHLSSAGEWDISGTYAASDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQLFTVVWGEQSCIIHLPERLEDTTKRLILPCH

SEQ ID NO: 16396 - protein, 242 aa, Escherichia coli MS 146-1; identical to SEQ ID NO: 6420

SEQ ID NO: 16397 - protein, 721 aa, Escherichia coli MS 146-1
MKTQITFAALLPALASFIPLHAHASSTSEDEMIVTGNTAADTTDSAAGAGFKTNDIDVGPLGTKSWIETPYSSTTVTKEMIENQQAQSVSEMLKYSPSTQMQARGGMDVGRPQSRGMQGSVVANSRLDGLNIVSTTAFTVEMLERMDVLNSLTGALYGPASPAGQFNFVAKRPTEETLRKVTLGYQSRSAFTGHADLGGHFDENKRFGYRVNLLDQEGEGNVDDSTLRRKLVSVALDWNIQPGTQLQLDASHYEFIQKGYVGSFNYGPNVKLPSAPNPKDKNLALSTAGNDLTTDTISTRLIHYFNDDWSMNAGVGWQQADRAMRSVSSKILNNQGDISRSMKDSTAAGRFRVLSNTAGLNGHIDTGSIGHDLSLSTTGYVWSLYSAKGTGSSYSWGTTNMYHPDAIDEQGDGKIRTGGPRYRSSVNTQQSVTLGDTVTFTPQWSAMFYLSQSWLQTKNYDKHGNQTNQVDENGLSPNAALMYKITPNTMAYVSYADSLEQGGTAPTDESVKNAGQTLNPYRSKQYEVGLKSDIGEMNLGAALFRLERPFAYLDTDNVYKEQGNQVNNGLELTAAGNVWQGLNIYSGVTFLDPKLKDTANASTSNKQVVGVPKVQANLLAEYSLPSIPEWVYSANVHYTGKRAANDTNTSYASSYTTWDLVTRYTTKVSNVPTTFRVVVNNVFDKHYWASIFPSGTDGDNGSPSAFIGGGREVRASVTFDF

SEQ ID NO: 16398 - protein, 862 aa, Escherichia coli MS 146-1; identical to SEQ ID NO: 14926

SEQ ID NO: 16399 - protein, 250 aa, Escherichia coli MS 146-1; identical to SEQ ID NO: 6361

SEQ ID NO: 16400 - protein, 274 aa, Escherichia coli MS 146-1; identical to SEQ ID NO: 6362

SEQ ID NO: 16401 - protein, 192 aa, Escherichia coli MS 146-1; identical to SEQ ID NO: 8037

SEQ ID NO: 16402 - protein, 367 aa, Escherichia coli MS 146-1; identical to SEQ ID NO: 5789

SEQ ID NO: 16403 - protein, 111 aa, Escherichia coli MS 146-1; identical to SEQ ID NO: 8122

SEQ ID NO: 16404 - protein, 431 aa, Escherichia coli MS 146-1; identical to SEQ ID NO: 6791

SEQ ID NO: 16405 - protein, 207 aa, Escherichia coli MS 146-1; identical to SEQ ID NO: 5743

SEQ ID NO: 16406 - protein, 554 aa, Escherichia coli MS 146-1
MALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVANMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 16407 - protein, 121 aa, Escherichia coli MS 146-1; identical to SEQ ID NO: 6059

SEQ ID NO: 16408 - protein, 518 aa, Escherichia coli MS 146-1; identical to SEQ ID NO: 6358

SEQ ID NO: 16409 - protein, 784 aa, Escherichia coli MS 146-1; identical to SEQ ID NO: 6283

SEQ ID NO: 16410 - protein, 208 aa, Escherichia coli MS 146-1; identical to SEQ ID NO: 5717

SEQ ID NO: 16411 - protein, 746 aa, Escherichia coli MS 146-1; identical to SEQ ID NO: 6710

SEQ ID NO: 16412 - protein, 869 aa, Escherichia coli MS 146-1
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTVLGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGGGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 16413 - protein, 230 aa, Escherichia coli MS 146-1; identical to SEQ ID NO: 6360

SEQ ID NO: 16414 - protein, 861 aa, Escherichia coli MS 153-1; identical to SEQ ID NO: 7583

SEQ ID NO: 16415 - protein, 241 aa, Escherichia coli MS 153-1; identical to SEQ ID NO: 7582

SEQ ID NO: 16416 - protein, 353 aa, Escherichia coli MS 153-1; identical to SEQ ID NO: 6846

SEQ ID NO: 16417 - protein, 713 aa, Escherichia coli MS 153-1; identical to SEQ ID NO: 6056

SEQ ID NO: 16418 - protein, 222 aa, Escherichia coli MS 153-1; identical to SEQ ID NO: 5850

SEQ ID NO: 16419 - protein, 840 aa, Escherichia coli MS 153-1; identical to SEQ ID NO: 5851

SEQ ID NO: 16420 - protein, 249 aa, Escherichia coli MS 153-1; identical to SEQ ID NO: 5852

SEQ ID NO: 16421 - protein, 478 aa, Escherichia coli MS 153-1; identical to SEQ ID NO: 6796

SEQ ID NO: 16422 - protein, 836 aa, Escherichia coli MS 153-1
MKDRIPFAVNNITCVILLSLFCNAASAVEFNTDVLDAADKKNIDFTRFSEAGYVLPGQYLLDVIVNGQSISPASLQISFVEPALSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDAHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVMTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 16423 - protein, 244 aa, Escherichia coli MS 153-1; identical to SEQ ID NO: 14671

SEQ ID NO: 16424 - protein, 825 aa, Escherichia coli MS 153-1; identical to SEQ ID NO: 8201

SEQ ID NO: 16425 - protein, 230 aa, Escherichia coli MS 153-1; identical to SEQ ID NO: 8200

SEQ ID NO: 16426 - protein, 726 aa, Escherichia coli MS 153-1
MSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMIGYSFDHEFNDTFTVRQNLRFAQNKVSQKSVYGYGMCSDPLYTKDQEALKASPCLSIPQSQWGHTLTRQYVIDNEKLENFSVDTQLQSKFATGSVDHTLLTGVDFMRMRNDIDSWFGYAGSVAPSDIYNLDRSDFDFGAHPNPSGPYRVLLKQKQTGLYVQDQAQWDKVLVTLGGRYDWADQSSFNRDYGNKSERDDKEFTWRGGVNYLFDNGVTPYFSYSESFEPASQTDANGDLFAPSKGKQYEVGVKYVPEDRPIVVTGALYQLTKTNNLMADPNGSLFSVEGGEIRARGVELEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 16427 - protein, 266 aa, Escherichia coli MS 153-1; identical to SEQ ID NO: 6841

SEQ ID NO: 16428 - protein, 161 aa, Escherichia coli MS 153-1; identical to SEQ ID NO: 5769

SEQ ID NO: 16429 - protein, 690 aa, Escherichia coli MS 153-1; identical to SEQ ID NO: 7614

SEQ ID NO: 16430 - protein, 224 aa, Escherichia coli MS 153-1; identical to SEQ ID NO: 5893

SEQ ID NO: 16431 - protein, 831 aa, Escherichia coli MS 153-1; identical to SEQ ID NO: 6814

SEQ ID NO: 16432 - protein, 696 aa, Escherichia coli MS 153-1; identical to SEQ ID NO: 6787

SEQ ID NO: 16433 - protein, 305 aa, Escherichia coli MS 153-1
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGGG

SEQ ID NO: 16434 - protein, 432 aa, Escherichia coli MS 153-1; identical to SEQ ID NO: 5727

SEQ ID NO: 16435 - protein, 784 aa, Escherichia coli MS 153-1; identical to SEQ ID NO: 6829

SEQ ID NO: 16436 - protein, 878 aa, Escherichia coli MS 153-1; identical to SEQ ID NO: 6809

SEQ ID NO: 16437 - protein, 241 aa, Escherichia coli MS 153-1; identical to SEQ ID NO: 6139

SEQ ID NO: 16438 - protein, 368 aa, Escherichia coli MS 153-1; identical to SEQ ID NO: 8204

SEQ ID NO: 16439 - protein, 192 aa, Escherichia coli MS 153-1
MNFAAQYQGKNDRTDVTEANGDGFGFSTTYEYEGFGVGATYAKSDRTDGQVAYGKSKFNASGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 16440 - protein, 721 aa, Escherichia coli MS 153-1; identical to SEQ ID NO: 6807

SEQ ID NO: 16441 - protein, 753 aa, Escherichia coli MS 153-1; identical to SEQ ID NO: 5801

SEQ ID NO: 16442 - protein, 208 aa, Escherichia coli MS 153-1; identical to SEQ ID NO: 5869

SEQ ID NO: 16443 - protein, 614 aa, Escherichia coli MS 153-1; identical to SEQ ID NO: 5872

SEQ ID NO: 16444 - protein, 431 aa, Escherichia coli MS 153-1; identical to SEQ ID NO: 6791

SEQ ID NO: 16445 - protein, 331 aa, Escherichia coli MS 153-1; identical to SEQ ID NO: 8190

SEQ ID NO: 16446 - protein, 760 aa, Escherichia coli MS 153-1
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDLSTGVEFTRETQTNYGVNPVTLPAVNIYHPDSSIHPGGLTRNGANANGQTDTFAIYAFDTLQITRDFELNGGIRLDNYHTEYDIATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 16447 - protein, 900 aa, Escherichia coli MS 153-1
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPGSCSVKPDNNGGAVTPVDPTPETPETPVTPTPDNNEPSTPADSSNDYSLQAWSGQEGSEIYHVIFNGNVYQNAWWVGSEDCPRGTSVENSDNPWRLVRTATAAEMSQYGNPTTCEIDNGGVIIANGFQASKAYSANSIVDYNDAHYKTSVDQDAWGFVPGGDNPWKKYEPAKAWSASTVYVKGDRVVVDGQAYEALFWTQSDNPALVANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 16448 - protein, 654 aa, Escherichia coli MS 153-1; identical to SEQ ID NO: 6816

SEQ ID NO: 16449 - protein, 882 aa, Escherichia coli MS 153-1; identical to SEQ ID NO: 8245

SEQ ID NO: 16450 - protein, 242 aa, Escherichia coli MS 153-1
MLVSTALMALLTTASLTAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRRPWQFKVTLTRSGQDYTVNNPTPYHVIISDASTQKKGLTAAGFKPLVMPPKTSQPLKAKMASAPVLTYINDYGARMPLIFRCEGNTCKVDEDQSSKG

SEQ ID NO: 16451 - protein, 274 aa, Escherichia coli MS 153-1; identical to SEQ ID NO: 5899

SEQ ID NO: 16452 - protein, 192 aa, Escherichia coli MS 153-1; identical to SEQ ID NO: 7823

SEQ ID NO: 16453 - protein, 375 aa, Escherichia coli MS 153-1; identical to SEQ ID NO: 5922

SEQ ID NO: 16454 - protein, 169 aa, Escherichia coli MS 153-1; identical to SEQ ID NO: 8240

SEQ ID NO: 16455 - protein, 111 aa, Escherichia coli MS 153-1; identical to SEQ ID NO: 5889

SEQ ID NO: 16456 - protein, 224 aa, Escherichia coli MS 153-1; identical to SEQ ID NO: 8215

SEQ ID NO: 16457 - protein, 883 aa, Escherichia coli MS 153-1
MTAFRAAFKAYRMHQVLILPRFARLTFALGLATAVFPVDAEYYFNPRFLSNDLAESVDLSAFTKGREAPPGTYRVDIYLNDEFMASRGITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNVQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 16458 - protein, 629 aa, Escherichia coli MS 153-1
MTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 16459 - protein, 250 aa, Escherichia coli MS 153-1; identical to SEQ ID NO: 5862

SEQ ID NO: 16460 - protein, 249 aa, Escherichia coli MS 153-1
MIKVVIVLFSLLFSTAQAGLVIGGTRFAYPENQSSISVELKNTSDRDMLVKVAVSPDDARQLTGTVESLPSYSETVFIATPPLFILKPDKNTKIRINRVGGSLPADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDIYNNVLPILKVKLNPSQLDVTGFAFSQ

SEQ ID NO: 16461 - protein, 386 aa, Escherichia coli MS 153-1
MVDDVPVAQVLQALAEQEKLNLVVSPDVSGTVSLHLTDVPWKQALQTVVKSAGLITRQEGNILSVHSVAWQNDNIARQEAEQARAQANLPLENRNITLQYADAGELAKAGEKLLSAKGSMTVDKRTNRLLLRDNKTALSTLEQWVSQMDLPVGQVELSAHIVTINEKSLRELGVKWTLADAQQAGGVGQVTTLGSDLSVATATTHIGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 16462 - protein, 446 aa, Escherichia coli MS 153-1; identical to SEQ ID NO: 5873

SEQ ID NO: 16463 - protein, 733 aa, Escherichia coli MS 153-1; identical to SEQ ID NO: 6152

SEQ ID NO: 16464 - protein, 746 aa, Escherichia coli MS 153-1; identical to SEQ ID NO: 6783

SEQ ID NO: 16465 - protein, 681 aa, Escherichia coli MS 153-1
MTLSVWRKKTTGLKTKKRLLALVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 16466 - protein, 204 aa, Escherichia coli MS 153-1; identical to SEQ ID NO: 5755

SEQ ID NO: 16467 - protein, 362 aa, Escherichia coli MS 153-1; identical to SEQ ID NO: 5874

SEQ ID NO: 16468 - protein, 517 aa, Escherichia coli MS 153-1; identical to SEQ ID NO: 6817

SEQ ID NO: 16469 - protein, 191 aa, Escherichia coli MS 153-1; identical to SEQ ID NO: 6818

SEQ ID NO: 16470 - protein, 729 aa, Escherichia coli MS 153-1; identical to SEQ ID NO: 6821

SEQ ID NO: 16471 - protein, 213 aa, Escherichia coli MS 153-1
MTKMSRYALITALAMFLAGCVGQREPAPVEEVKPAPEQPAEPQQPVPTVPSVPTIPQQPGPIEHEDQTAPLAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 16472 - protein, 1024 aa, Escherichia coli MS 153-1; identical to SEQ ID NO: 7555

SEQ ID NO: 16473 - protein, 222 aa, Escherichia coli MS 153-1
DGRDYDPEVLLRAVNDAVGKLPVPADGKSITPDDVRPMLEQMVTDAVSHIPVPRDGRDYDPEVLQKAVLDAVSALPAPQDGRDATALEIFPAIDEQKSFPRGTYATHQGGLWRAYEKTHGMRGWECLVDGVADIDVSMTGERSFTVVVRQSSGQCTEKTFSLPVMLYRGVFRTGETYHPGDTVTWGGSLWHCNSMTGDKPGEAHSSGWTLAAKRGRDAGGGK

SEQ ID NO: 16474 - protein, 656 aa, Escherichia coli MS 153-1
MRLKKRYLCTVLSLAFTQQSVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDTPPYSGNSGQKSRYWQWPEYDKESFYYQGTTQLNDRFTLKSRLYHDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 16475 - protein, 229 aa, Escherichia coli MS 153-1; identical to SEQ ID NO: 6845

SEQ ID NO: 16476 - protein, 656 aa, Escherichia coli MS 153-1; identical to SEQ ID NO: 7573

SEQ ID NO: 16477 - protein, 541 aa, Escherichia coli MS 153-1; identical to SEQ ID NO: 15907

SEQ ID NO: 16478 - protein, 700 aa, Escherichia coli MS 153-1; identical to SEQ ID NO: 6848

SEQ ID NO: 16479 - protein, 122 aa, Escherichia coli MS 153-1; identical to SEQ ID NO: 5737

SEQ ID NO: 16480 - protein, 360 aa, Escherichia coli MS 153-1; identical to SEQ ID NO: 5891

SEQ ID NO: 16481 - protein, 673 aa, Escherichia coli MS 153-1; identical to SEQ ID NO: 6170

SEQ ID NO: 16482 - protein, 719 aa, Escherichia coli MS 153-1; identical to SEQ ID NO: 8210

SEQ ID NO: 16483 - protein, 119 aa, Escherichia coli MS 153-1; identical to SEQ ID NO: 5803

SEQ ID NO: 16484 - protein, 518 aa, Escherichia coli MS 153-1; identical to SEQ ID NO: 8246

SEQ ID NO: 16485 - protein, 353 aa, Escherichia coli MS 16-3; identical to SEQ ID NO: 6846

SEQ ID NO: 16486 - protein, 825 aa, Escherichia coli MS 16-3
MGKDASNIDLSRYTEGNPTLPGIYDVSVYVNDQPIMSQSIAFAVIEGKKNAQACITQKNLLQFHISSPDKNSEKAILLKRDEDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNTTSEKIAQSIILNGLRCQIQ

SEQ ID NO: 16487 - protein, 230 aa, Escherichia coli MS 16-3; identical to SEQ ID NO: 8200

SEQ ID NO: 16488 - protein, 726 aa, Escherichia coli MS 16-3; identical to SEQ ID NO: 16426

SEQ ID NO: 16489 - protein, 266 aa, Escherichia coli MS 16-3; identical to SEQ ID NO: 5772

SEQ ID NO: 16490 - protein, 161 aa, Escherichia coli MS 16-3; identical to SEQ ID NO: 5769

SEQ ID NO: 16491 - protein, 719 aa, Escherichia coli MS 16-3; identical to SEQ ID NO: 8210

SEQ ID NO: 16492 - protein, 673 aa, Escherichia coli MS 16-3
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRSYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 16493 - protein, 518 aa, Escherichia coli MS 16-3
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKDTKFPELSWKVDDKKGSVELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 16494 - protein, 208 aa, Escherichia coli MS 16-3; identical to SEQ ID NO: 5869

SEQ ID NO: 16495 - protein, 785 aa, Escherichia coli MS 16-3
MKKEIFIAAIIFHLLSKGALAEEFNYSFIRGGSKDIPDVLNSNKENVPGKYVVDVVFNGSKIASSTEMSIAKEDAEGICLSDEWLTENGIIINKDFYKNVYNSARQCYLLGNEANSKVAFDQSLQEVSIDLPQAGFQDAAKDGGVWDYGSNGFKIAYDVNTAKNSNQERTTYSSIDGQVNLGEWVLLGRGYAYQGENFDTNNLLLTRAIKSLKSDLQLGKTQLYNSLNNGFTFYGAQLKSNQDMYPWNSRAYSPVINGIARTHARVTIEQSGYTLKSIVVPPGPFVINDLNGVYSGDLIMKIYEEDGSVREQRFPVAVLPNLLRPGTYNYALAMGSKVNQDNGERDQESLFAQMSYDYGFEPFTLNSSLLLDKNYNNIGLGLIRSFGWFGAMSFSGNLSQAKYHNGKNLKGYSTSLKYAKALGDNANLQLIGYRFNSEDYIDYADFTYNSYSFIRNRPKQRYESIVTYQLPEKGMFLNFSAWKEDYWDNYNEVGANLSLTKSFDQITMTLNGGYSRLQNMDADYNVGLSLSVPLSLFDKTHYSFSNVNYDRRTGTSMNTGISGMINQRLSYNASVNQTRDTIGGTLSASYLFDWMQTSATYSQTGKNSSTSLQLGGSVIGVPEGGIIFTPVKNDQLAIVQMKDVPGVMFNGSLPGDKYGRAVIPLTAYNNNTISVNAEKLPKNIELTDNAINVTPTGNAIIYKNVKFKKINTYVVKLYGKNGYVVPMGSIAKNTQGKEVGYVNNGGILLMNLETHDEGVISLDQCQFNTQSLKKNHDQTQEIHCE

SEQ ID NO: 16496 - protein, 226 aa, Escherichia coli MS 16-3
MKKINLMPVLALLLICFNSHAAFVLNSTRYIFAGDKDNISVQVNNESSQEYGGQIWIDNANARDQNVYFAPSPTFFKVSGGHKQILRVLKINDSLPKDKESLFWVNVQEIPKAPKEGTNSLAIALHTQVKMIYRPESLKEGREDAEKNIKIIHEGGNTILYNNSPYYFAVINVKQNGHDVKLSEETKNKIAAFAPFEKVSLGSKLSGKDISIVSFDDYGVDREYKL

SEQ ID NO: 16497 - protein, 228 aa, Escherichia coli MS 16-3
MKRISLAVLALLMTAQQCFAGGVALSTTRVIYDGGKKEASLTVENHNKNEEFLIQSWIDDVNGNKKTPFIITPPLFKLDPDKNNVLRIVNIEDTLPKDRESVYWINVKAIPAKSAENENKNVLQIAVRTRLKLFYRPKGLPGSNLEAMKQLRFQRQNNQIVVNNDSAYNLTFNQISINGQKIERAGMVLAKGTLNINLPAGTGNANEVKYSIINDFGVAGEMLTKSIN

SEQ ID NO: 16498 - protein, 843 aa, Escherichia coli MS 16-3
MHWMHLPLDHYRAHFSFSLLALTIASALPAYGGKFNPKFLENVQGIDQHVDLSVYDSPVGQQIPGKYRVFVFVNEEKMASRTLDFSTASEAQRKASGESLMPCLSRVQLEEMGVRVDSFPALKILPPEACVAFDEIIPQATSRFDFNTQTLHLTFPQAAMMMTARGTVDPSRWDEGIPALLLDYSFSGSNGRNEGSGSSPDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKESDGSEQRFIQPFSAVAIFQREGYLKYSLAAGEYRAGNYDSGKPRFGQFTAMYGLPWGMTAYGGALLSADYNALALGLGKNFGTIGAVSVDVTQAKSQLRNNEKDEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSIAYTWTRSPEWDEDDRLWSFSLSIPLGGAWGSYRMTTDQNGKTSQQASVSGTLLEDRNLNYNVQQGYTSNGVGNSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNLELQEAFQKVVPTRGAIVRSRFDTRVGYRVLMSLKRANGNAVPFGATAALSDESKPASSIVGEEGQLYISGMPEEGELQVSWGHEQAQRCRVPFRLPEKKDNSGIVMVNAVCDK

SEQ ID NO: 16499 - protein, 413 aa, Escherichia coli MS 16-3
MDSRGNPTIEVDVITQCNTFARASVPSGASTGSREAIERRDDDKTHFGGKGVLKAIESVNTEINDSLKGHDVRDQRGIDDIMIALDGTENKARLGANAILGVSLATARLAAQLSHTPLYRYLGGIGANLLPVPCMNIINGGVHARGQGADFQEYMIAPCGAPTFREAVRWGSEVYHSLRQVLLEKGMLTGVGDEGGFAPVVSSNREPLELIVLAIEKAGYRPGEDIVICMDPASSEFYRDGKYHLRTENTELTSQEMTNYYQALVKNFPIALIEDGLAEDDWAGWKILHGALGEQIELVGDDLFVTNVKYIQRGIDENLANSALIKLNQIGSLSETFDAVQLCHDNNWGTFISHRSGETVDSFIADMTVAMRAGHLKMGAPCRGERIEKYNQLMRIEDELGSSAQFAGKSAFK

SEQ ID NO: 16500 - protein, 122 aa, Escherichia coli MS 16-3; identical to SEQ ID NO: 5737

SEQ ID NO: 16501 - protein, 733 aa, Escherichia coli MS 16-3; identical to SEQ ID NO: 6078

SEQ ID NO: 16502 - protein, 831 aa, Escherichia coli MS 16-3
MQELPMLRMTPLASAIVALLIGIEAYAAEETFDTHFMIGGMKDQQVSNIRLEDNQPLPGQYDIDIYVNKQWRGKYEIIVKDNPQETCLSREMIKRLGINTDSFASGKQCLTFKQLIQGGSYTWDIGVFRLDFSVPQAWVEELESGYVPPENWERGINAFYTSYYMSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNVLVTIEQNGFVVYQKEVPPGPFAITDLQLAGGGADLDVSVKEADGSVTTYLVPYAAVPNMLQPGVSKYDFAAGRSHIEGASKQSDFVQAGHQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 16503 - protein, 224 aa, Escherichia coli MS 16-3
MKGLLALLISSMVLPAHAGIVIYGTRIIYPAEHKEVMVQLMNQGNRSSLMQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQGVNVKSNNANNWHLTIIDDHGNYISDKI

SEQ ID NO: 16504 - protein, 760 aa, Escherichia coli MS 16-3
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSVWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSITDTATMRFEHDINDNATIRNTTRWSRVKQDYLMTAIMGGASNITQPTSDVNSWTWSRTANTKDVSNKILTNQTNLTSTFYTGAIGHDLSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 16505 - protein, 331 aa, Escherichia coli MS 16-3
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLVAPSDGTLLTRAVEPGTVLNEGGTVFTVSLTRPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 16506 - protein, 431 aa, Escherichia coli MS 16-3; identical to SEQ ID NO: 6791

SEQ ID NO: 16507 - protein, 746 aa, Escherichia coli MS 16-3; identical to SEQ ID NO: 6783

SEQ ID NO: 16508 - protein, 368 aa, Escherichia coli MS 16-3; identical to SEQ ID NO: 7561

SEQ ID NO: 16509 - protein, 432 aa, Escherichia coli MS 16-3; identical to SEQ ID NO: 5727

SEQ ID NO: 16510 - protein, 505 aa, Escherichia coli MS 16-3; identical to SEQ ID NO: 14677

SEQ ID NO: 16511 - protein, 654 aa, Escherichia coli MS 16-3; identical to SEQ ID NO: 8265

SEQ ID NO: 16512 - protein, 900 aa, Escherichia coli MS 16-3
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSTSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPASCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSANSIVDYNDAHYKTSVDQDAWGFVPGGDNPWKKYEPAKAWSASTVYVKGDRVVVDGQAYEALFWTQSDNPALIANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 16513 - protein, 700 aa, Escherichia coli MS 16-3
MKIFSVRQTVLPALLVLSPVVFAADEQTMIVSAASQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPFLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYIPEDGWYAGTEARYMGDIMADDENTAKAPSYTLVGLFTGYKYNYHNFTVDLFGRVDNLFDKEYVGSVIVNESNGRYYEPAPGRNYGVGINIAWRFE

SEQ ID NO: 16514 - protein, 541 aa, Escherichia coli MS 16-3
MAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKNQVIMDVENHLYARKDIKQLGIAPMTSMFSCGTNERRMCDTIHPQIHDSDRLSMWRGNGEWICRPLNNPQKLQFNAYTDNNLKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 16515 - protein, 614 aa, Escherichia coli MS 16-3
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDVWSGFVRGYGYDNRTNYDAYYSPGLPLVDTRKLYSQSWDAGLRYNGELIKSQLISSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGTYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 16516 - protein, 784 aa, Escherichia coli MS 16-3
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYKDEHPNDDSSRRWLFYWKHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTRLAESANRVMPQFKVDGRMVFERDMEMLAPGYTQTLEPRAQYLYVPYRDQSKIYNYDSSLLQSDYSGLFRDRTYGGLDRIASANQVTTGVTSRIYDDAAVERFNISVGQIYYFTESRTGDDNITWENDDKTGSLVWAGDTYWRISDRWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 16517 - protein, 878 aa, Escherichia coli MS 16-3; identical to SEQ ID NO: 14664

SEQ ID NO: 16518 - protein, 241 aa, Escherichia coli MS 16-3; identical to SEQ ID NO: 6140

SEQ ID NO: 16519 - protein, 882 aa, Escherichia coli MS 16-3
MPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKHWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSADGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 16520 - protein, 242 aa, Escherichia coli MS 16-3
MLVSTALMAMLTTASLTAHASVTPDRTRLVFNESDKSISVTLRNNNEKLPYLAQSWLEDEKGNKIISPLAVLPPVQRIDAMMNGQVKIQALPDIHTLPSDRESLFYYNVREIPPKSGKANTLQIALQTRIKLFWRPKALENIDMRKPWQFKVTLTRSGQDYTVNNPTPYHVIISDASTQKKGLTAAGFKPLVMPPKTSQPLKAKMASAPVLTYINDYGARMPLIFRCEGNTCKVDEDQSSKG

SEQ ID NO: 16521 - protein, 274 aa, Escherichia coli MS 16-3; identical to SEQ ID NO: 14653

SEQ ID NO: 16522 - protein, 192 aa, Escherichia coli MS 16-3
MKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDERFLQCGNEIYSAIKDLQRKAPDKNIVIFTHNHCLTYIAKDKRDATFKPDYLDGLVMHVEKGKVYLDGEFVNH

SEQ ID NO: 16523 - protein, 376 aa, Escherichia coli MS 16-3
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVDGEGMTNNGRGALRQNGDGVGGSITYDYEGFGIGAAVSSSKRTDAQNGTYVSDNNVVRNYIGTGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 16524 - protein, 169 aa, Escherichia coli MS 16-3; identical to SEQ ID NO: 8240

SEQ ID NO: 16525 - protein, 728 aa, Escherichia coli MS 16-3; identical to SEQ ID NO: 8238

SEQ ID NO: 16526 - protein, 222 aa, Escherichia coli MS 16-3; identical to SEQ ID NO: 5850

SEQ ID NO: 16527 - protein, 713 aa, Escherichia coli MS 16-3
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTNKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 16528 - protein, 681 aa, Escherichia coli MS 16-3
MTLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 16529 - protein, 721 aa, Escherichia coli MS 16-3; identical to SEQ ID NO: 6807

SEQ ID NO: 16530 - protein, 446 aa, Escherichia coli MS 16-3; identical to SEQ ID NO: 5873

SEQ ID NO: 16531 - protein, 478 aa, Escherichia coli MS 16-3; identical to SEQ ID NO: 6796

SEQ ID NO: 16532 - protein, 883 aa, Escherichia coli MS 16-3
MTAFRAAFKAYRMHQVLILTRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGNLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNVQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 16533 - protein, 224 aa, Escherichia coli MS 16-3; identical to SEQ ID NO: 8215

SEQ ID NO: 16534 - protein, 111 aa, Escherichia coli MS 16-3; identical to SEQ ID NO: 5889

SEQ ID NO: 16535 - protein, 656 aa, Escherichia coli MS 16-3
MRLKKRYLCTVLSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEANLGYRQGWSRSHDNAYDMHASFAASSDLGYLQVSGSQLKQDFLGLPHGVNNDIAGKHGKMINSSADDKHGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 16536 - protein, 229 aa, Escherichia coli MS 16-3
MANGNASIKGYNCNVSQGLVIIMPLPDFRFIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTSDDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 16537 - protein, 725 aa, Escherichia coli MS 16-3; identical to SEQ ID NO: 6197

SEQ ID NO: 16538 - protein, 517 aa, Escherichia coli MS 16-3; identical to SEQ ID NO: 6817

SEQ ID NO: 16539 - protein, 191 aa, Escherichia coli MS 16-3
MKKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDELDITGNLTLNGVTKPVTLEAKLIGQGDDPWGGKRAGFEAEGKIKLKDFNIKTDLGPASQEVDLIISVEGVQQK

SEQ ID NO: 16540 - protein, 235 aa, Escherichia coli MS 16-3; identical to SEQ ID NO: 6404

SEQ ID NO: 16541 - protein, 213 aa, Escherichia coli MS 16-3; identical to SEQ ID NO: 5744

SEQ ID NO: 16542 - protein, 729 aa, Escherichia coli MS 16-3; identical to SEQ ID NO: 5878

SEQ ID NO: 16543 - protein, 360 aa, Escherichia coli MS 16-3; identical to SEQ ID NO: 5891

SEQ ID NO: 16544 - protein, 121 aa, Escherichia coli MS 16-3; identical to SEQ ID NO: 6175

SEQ ID NO: 16545 - protein, 362 aa, Escherichia coli MS 16-3
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEESPLGKGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 16546 - protein, 204 aa, Escherichia coli MS 16-3; identical to SEQ ID NO: 5755

SEQ ID NO: 16547 - protein, 629 aa, Escherichia coli MS 16-3; identical to SEQ ID NO: 16458

SEQ ID NO: 16548 - protein, 250 aa, Escherichia coli MS 16-3; identical to SEQ ID NO: 14682

SEQ ID NO: 16549 - protein, 249 aa, Escherichia coli MS 16-3; identical to SEQ ID NO: 16460

SEQ ID NO: 16550 - protein, 386 aa, Escherichia coli MS 16-3
MVDDVPVAQVLQALAEQEKLNLVVSPDVSGTVSLHLTDVPWKQALQTVVKSAGLITRQEGNILSVHSVAWQNDNVARQEVEQTRAQANLPLENRNITLQYADAGELAKAGEKLLSAKGSMTVDKRTNRLLLRDNKTALSTLEQWVSQMDLPVGQVELSAHIVTINEKSLRELGVKWTLADAQQAGGVGQVTTLGSDLSVATATTHIGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 16551 - protein, 304 aa, Escherichia coli MS 16-3
MMKKYLALALIAPLLISCSTTKKGNTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRANNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGA

SEQ ID NO: 16552 - protein, 541 aa, Escherichia coli MS 175-1; identical to SEQ ID NO: 6754

SEQ ID NO: 16553 - protein, 360 aa, Escherichia coli MS 175-1; identical to SEQ ID NO: 6702

SEQ ID NO: 16554 - protein, 230 aa, Escherichia coli MS 175-1; identical to SEQ ID NO: 6360

SEQ ID NO: 16555 - protein, 867 aa, Escherichia coli MS 175-1; identical to SEQ ID NO: 6359

SEQ ID NO: 16556 - protein, 235 aa, Escherichia coli MS 175-1; identical to SEQ ID NO: 6404

SEQ ID NO: 16557 - protein, 191 aa, Escherichia coli MS 175-1; identical to SEQ ID NO: 5748

SEQ ID NO: 16558 - protein, 517 aa, Escherichia coli MS 175-1; identical to SEQ ID NO: 6406

SEQ ID NO: 16559 - protein, 204 aa, Escherichia coli MS 175-1; identical to SEQ ID NO: 5755

SEQ ID NO: 16560 - protein, 614 aa, Escherichia coli MS 175-1
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSGDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 16561 - protein, 650 aa, Escherichia coli MS 175-1; identical to SEQ ID NO: 6393

SEQ ID NO: 16562 - protein, 897 aa, Escherichia coli MS 175-1; identical to SEQ ID NO: 6392

SEQ ID NO: 16563 - protein, 813 aa, Escherichia coli MS 175-1; identical to SEQ ID NO: 6424

SEQ ID NO: 16564 - protein, 231 aa, Escherichia coli MS 175-1; identical to SEQ ID NO: 6400

SEQ ID NO: 16565 - protein, 349 aa, Escherichia coli MS 175-1
MQELPMLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAA

SEQ ID NO: 16566 - protein, 239 aa, Escherichia coli MS 175-1; identical to SEQ ID NO: 6428

SEQ ID NO: 16567 - protein, 236 aa, Escherichia coli MS 175-1; identical to SEQ ID NO: 6409

SEQ ID NO: 16568 - protein, 565 aa, Escherichia coli MS 175-1
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSVASKLTGIRINRIGYYSLATTRKLKIFRWGFPGTTVSPVVNLMLIRCLL

SEQ ID NO: 16569 - protein, 233 aa, Escherichia coli MS 175-1; identical to SEQ ID NO: 6411

SEQ ID NO: 16570 - protein, 362 aa, Escherichia coli MS 175-1; identical to SEQ ID NO: 5809

SEQ ID NO: 16571 - protein, 368 aa, Escherichia coli MS 175-1; identical to SEQ ID NO: 7693

SEQ ID NO: 16572 - protein, 554 aa, Escherichia coli MS 175-1; identical to SEQ ID NO: 15864

SEQ ID NO: 16573 - protein, 207 aa, Escherichia coli MS 175-1; identical to SEQ ID NO: 5743

SEQ ID NO: 16574 - protein, 353 aa, Escherichia coli MS 175-1
MKMKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLPLQYKGKNENRDVKKQNGDGFGTSLTYDFGGSDFSISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 16575 - protein, 793 aa, Escherichia coli MS 175-1; identical to SEQ ID NO: 6397

SEQ ID NO: 16576 - protein, 663 aa, Escherichia coli MS 175-1; identical to SEQ ID NO: 6307

SEQ ID NO: 16577 - protein, 865 aa, Escherichia coli MS 175-1; identical to SEQ ID NO: 14886

SEQ ID NO: 16578 - protein, 230 aa, Escherichia coli MS 175-1; identical to SEQ ID NO: 8021

SEQ ID NO: 16579 - protein, 747 aa, Escherichia coli MS 175-1
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQFVATATFRF

SEQ ID NO: 16580 - protein, 266 aa, Escherichia coli MS 175-1; identical to SEQ ID NO: 5772

SEQ ID NO: 16581 - protein, 161 aa, Escherichia coli MS 175-1; identical to SEQ ID NO: 5769

SEQ ID NO: 16582 - protein, 213 aa, Escherichia coli MS 175-1; identical to SEQ ID NO: 14910

SEQ ID NO: 16583 - protein, 729 aa, Escherichia coli MS 175-1
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQQFADIWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 16584 - protein, 862 aa, Escherichia coli MS 175-1; identical to SEQ ID NO: 14926

SEQ ID NO: 16585 - protein, 250 aa, Escherichia coli MS 175-1; identical to SEQ ID NO: 6361

SEQ ID NO: 16586 - protein, 274 aa, Escherichia coli MS 175-1
MNKTAIALLALLASSASLAATPWQKITQPVPGSAQSIGSFSNGCIVGADTLPIQSEHYQVMRTDQRRYFGHPDLVMFIQRLSSQVSNLGMGTVLIGDMGMPAGGRFNGGHASHQTGLDVDIFLQLPKTRWTSAQLLRPQALDLVSRDGKHVVSTLWKPEIFSLIKLAAQDKDVTRIFVNPAIKQQLCLDAGTDRDWLRKVRPWFQHRAHMHVRLRCPADSLECEDQPLPPSGDGCGAELQSWFEPPKPGTTKPEKKTPPPLPPFCQALLDEHVI

SEQ ID NO: 16587 - protein, 673 aa, Escherichia coli MS 175-1; identical to SEQ ID NO: 6170

SEQ ID NO: 16588 - protein, 122 aa, Escherichia coli MS 175-1; identical to SEQ ID NO: 5737

SEQ ID NO: 16589 - protein, 386 aa, Escherichia coli MS 175-1; identical to SEQ ID NO: 7993

SEQ ID NO: 16590 - protein, 169 aa, Escherichia coli MS 175-1; identical to SEQ ID NO: 15504

SEQ ID NO: 16591 - protein, 784 aa, Escherichia coli MS 175-1
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIAPANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQIGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 16592 - protein, 760 aa, Escherichia coli MS 175-1; identical to SEQ ID NO: 6415

SEQ ID NO: 16593 - protein, 478 aa, Escherichia coli MS 175-1; identical to SEQ ID NO: 5711

SEQ ID NO: 16594 - protein, 446 aa, Escherichia coli MS 175-1 [sequence omitted]

SEQ ID NO: 16595 - protein, 774 aa, Escherichia coli MS 175-1; identical to SEQ ID NO: 7694

SEQ ID NO: 16596 - protein, 242 aa, Escherichia coli MS 175-1; identical to SEQ ID NO: 6420

SEQ ID NO: 16597 - protein, 802 aa, Escherichia coli MS 175-1; identical to SEQ ID NO: 16041

SEQ ID NO: 16598 - protein, 431 aa, Escherichia coli MS 175-1; identical to SEQ ID NO: 6791

SEQ ID NO: 16599 - protein, 331 aa, Escherichia coli MS 175-1; identical to SEQ ID NO: 6551

SEQ ID NO: 16600 - protein, 432 aa, Escherichia coli MS 175-1; identical to SEQ ID NO: 5727

SEQ ID NO: 16601 - protein, 700 aa, Escherichia coli MS 175-1; identical to SEQ ID NO: 16047

SEQ ID NO: 16602 - protein, 208 aa, Escherichia coli MS 175-1; identical to SEQ ID NO: 5717

SEQ ID NO: 16603 - protein, 686 aa, Escherichia coli MS 175-1; identical to SEQ ID NO: 6339

SEQ ID NO: 16604 - protein, 834 aa, Escherichia coli MS 175-1; identical to SEQ ID NO: 7680

SEQ ID NO: 16605 - protein, 252 aa, Escherichia coli MS 175-1; identical to SEQ ID NO: 15541

SEQ ID NO: 16606 - protein, 518 aa, Escherichia coli MS 175-1; identical to SEQ ID NO: 6358

SEQ ID NO: 16607 - protein, 1653 aa, Escherichia coli MS 175-1
MKKLRVAACMLMLALAGCDNNDNAPTAVKKDAPSEVTKAASSENASSAKLSVPERQKLAQQSAGKVLTLLDLSEVQLDGAATLVLTFSIPLDPDQDFSRVIHVVDKKSGKVDGAWELSDNLKELRLRHLEPKRDLIVTIGKEVKALNNATFSKDYEKTITTRDIQPSVGFASRGSLLPGKVVEGLPVMALNVNNVDVNFFRVKPESLPAFISQWEYRNSLANWQSDKLLQMADLVYTGRFDLNPARNTREKLLLPLGDIKPLQQAGVYLAVMNQAGRYDYSNPATLFTLSDIGVSAHRYHNRLDIFTQSLENGAAQQGIEVSLLNEKGQTLTQATSDAQGHVQLENDKNAALLLARKDGQTTLLDLKLPALDLAEFNIAGAPGYSKQFFMFGPRDLYRPGETVILNGLLRDADGKALPNQPIKLDVIKPDGQVLRSVVSQPENGLYHFTWPLDSNAATGMWHIRANTGDNQYRMWDFHVEDFMPERMALNLTGEKTPLTPKDEVKFSVVGYYLYGAPANGNTLQGQLFLRPLREAVSALPGFEFGDIAAENLSRTLDEVQLTLDDKGRGEVSTESQWKETHSPLQVIFQGSLLESGGRPVTRRAEQAIWPADALPGIRPQFASKSVYDYRTDSTVKQPIVDEGSNAAFDIVYSDAQGVKKAVSGLQVRLIRERRDYYWNWSEDEGWQSQFDQKDLIENEQTLDLKADETGKVSFPVEWGAYRLEVKAPNEAVSSVRFWAGYSWQDNSDGSGAVRPDRVTLKLDKASYRPGDTIKLHIAAPTAGKGYAMVESSEGPLWWQEIDVRAQGLDLTIPVDKTWNRHDLYLSTLVVRPGDKSRSATPKRAVGVLHLPLGDENRRLDLALETPAKMRPNQPLTVKIKASTKNGEKPKQVNVLVSAVDSGVLNITDYVTPDPWQAFFGQKRYGADIYDIYGQVIEGQGRLAALRFGGDGDELKRGGKPPVNHVNIVVQQALPVTLNEQGEGSVTLPIGDFNGELRVMAQAWTADDFGSNESKVIVAAPVIAELNMPRFMASGDTSRLTLDITNLTDKPQKLNVALTASGLLELVSDSPAAVELAPGVRTTLFIPVRALPGYGDGEIQATISGLALPGETVADQHKQWKIGVRPAFPAQTVNYGTALQPGETWAIPADGLQNFSPVTLEGQLLLSGKPPLNIARYIKELKAYPYGCLEQTASGLFPSLYTNAAQLQALGIKGDSDEKRRASVDIGISRLLQMQRDNGGFSLWDKNGDEEYWLTAYVMDFLVRAGEQGYSVPTDAINRGNERLLRYLQDPGMMSIPYADNLKASKFAVQSYAALVLARQQKAPLGALREIWEHRADAASGLPLLQLGVALKTMGDATRGEEAIALALKTPRNSDERIWLGDYGSSLRDNALMLSLLEENKLLPDEQYTLLNTLSQQAFGERWLSTQESNALFLAARTIQDLPGKWQAQTSFSAEQLTGEKAQNSNLNSDQLVTLQVSNSGDQPLWLRMDASGYPQSAPLPANNVLQIERHILGTDGKSKSLDSLRSGDLVLVWLQVKASNSVPDALVVDLLPAGLELENQNLANGSASLEQSGGEVQNLLNQMQQASIKHIEFRDDRFVAAVAVDEYQPVTLVYLARAVTPGTYQVPQPMVESMYVPQWRATGAAEDLLIVRP

SEQ ID NO: 16608 - protein, 367 aa, Escherichia coli MS 175-1; identical to SEQ ID NO: 5789

SEQ ID NO: 16609 - protein, 192 aa, Escherichia coli MS 175-1; identical to SEQ ID NO: 8037

SEQ ID NO: 16610 - protein, 111 aa, Escherichia coli MS 175-1; identical to SEQ ID NO: 8122

SEQ ID NO: 16611 - protein, 746 aa, Escherichia coli MS 175-1; identical to SEQ ID NO: 6710

SEQ ID NO: 16612 - protein, 700 aa, Escherichia coli MS 182-1; identical to SEQ ID NO: 7945

SEQ ID NO: 16613 - protein, 207 aa, Escherichia coli MS 182-1; identical to SEQ ID NO: 5743

SEQ ID NO: 16614 - protein, 554 aa, Escherichia coli MS 182-1
MALIPACIFLCFAALSVQAEETPVTPQPPDILLGPLFNDVQNAKLFPDQKTFADAVPNSDPLMILADYRMQQNQSGFDLLHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPHQLNTLRTTSIVPVDLNSLMFKMEKILARASKAAGDNAMANQYETLANARQKGIEKYMWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 16615 - protein, 353 aa, Escherichia coli MS 182-1; identical to SEQ ID NO: 15514

SEQ ID NO: 16616 - protein, 575 aa, Escherichia coli MS 182-1; identical to SEQ ID NO: 15363

SEQ ID NO: 16617 - protein, 250 aa, Escherichia coli MS 182-1; identical to SEQ ID NO: 6317

SEQ ID NO: 16618 - protein, 274 aa, Escherichia coli MS 182-1; identical to SEQ ID NO: 6549

SEQ ID NO: 16619 - protein, 774 aa, Escherichia coli MS 182-1; identical to SEQ ID NO: 13109

SEQ ID NO: 16620 - protein, 517 aa, Escherichia coli MS 182-1; identical to SEQ ID NO: 6817

SEQ ID NO: 16621 - protein, 191 aa, Escherichia coli MS 182-1; identical to SEQ ID NO: 5748

SEQ ID NO: 16622 - protein, 235 aa, Escherichia coli MS 182-1; identical to SEQ ID NO: 6404

SEQ ID NO: 16623 - protein, 729 aa, Escherichia coli MS 182-1; identical to SEQ ID NO: 6500

SEQ ID NO: 16624 - protein, 213 aa, Escherichia coli MS 182-1; identical to SEQ ID NO: 5744

SEQ ID NO: 16625 - protein, 331 aa, Escherichia coli MS 182-1; identical to SEQ ID NO: 6456

SEQ ID NO: 16626 - protein, 760 aa, Escherichia coli MS 182-1; identical to SEQ ID NO: 6455

SEQ ID NO: 16627 - protein, 541 aa, Escherichia coli MS 182-1; identical to SEQ ID NO: 6286

SEQ ID NO: 16628 - protein, 161 aa, Escherichia coli MS 182-1; identical to SEQ ID NO: 5769

SEQ ID NO: 16629 - protein, 266 aa, Escherichia coli MS 182-1; identical to SEQ ID NO: 5772

SEQ ID NO: 16630 - protein, 747 aa, Escherichia coli MS 182-1; identical to SEQ ID NO: 6343

SEQ ID NO: 16631 - protein, 230 aa, Escherichia coli MS 182-1; identical to SEQ ID NO: 7855

SEQ ID NO: 16632 - protein, 825 aa, Escherichia coli MS 182-1
MGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDETNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 16633 - protein, 432 aa, Escherichia coli MS 182-1; identical to SEQ ID NO: 5727

SEQ ID NO: 16634 - protein, 834 aa, Escherichia coli MS 182-1
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLATGVGFNLNSLGSLSFDVTRSDAQLHNQDKETGYSYRANYSKRFESTGSQLTFAGYRFSDKNFVTMNEYINDTNHYTNYQNEKESYIITFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 16635 - protein, 252 aa, Escherichia coli MS 182-1; identical to SEQ ID NO: 7371

SEQ ID NO: 16636 - protein, 673 aa, Escherichia coli MS 182-1
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQNVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 16637 - protein, 405 aa, Escherichia coli MS 182-1
MKIIITREYIMKRKVLAMLVPALLVAGAANAAEVYNKDGNKLDLYGKVAGLHYFSDDAGSDGDMSYARIGFKGETQIADQFTGYGQWEFNIGANGPESDKGNTATRLAFAGLGFGQNGTFDYGRNYGVVYDIEAWTDMLPEFGGDTYAGADNFMNGRANGVATYRNNGFFGQVDGLNFALQYQGNNEDDGLFGQEGSGNGNGRKLAKENGDGFGMSTSYDFDFGLSLGAAYSNSDRTDNQVHKGTHNTRYGDRFDATAGGETAEAWTVGAKYDANNVYLAAMYAETRNMTGYGDADAIANKTQNFEVVAQYQFDFGLRPSIAYLQSKGKDLGGVNSDNFDSQGNHHYTNKDLVKYVDIGMTYYFNKNISTYVDYKINLLDNDDDFYKENGIATDDIVAVGLVYQF

SEQ ID NO: 16638 - protein, 267 aa, Escherichia coli MS 182-1; identical to SEQ ID NO: 15862

SEQ ID NO: 16639 - protein, 836 aa, Escherichia coli MS 182-1; identical to SEQ ID NO: 14687

SEQ ID NO: 16640 - protein, 784 aa, Escherichia coli MS 182-1; identical to SEQ ID NO: 12980

SEQ ID NO: 16641 - protein, 446 aa, Escherichia coli MS 182-1; identical to SEQ ID NO: 6459

SEQ ID NO: 16642 - protein, 478 aa, Escherichia coli MS 182-1; identical to SEQ ID NO: 8471

SEQ ID NO: 16643 - protein, 224 aa, Escherichia coli MS 182-1; identical to SEQ ID NO: 6435

SEQ ID NO: 16644 - protein, 831 aa, Escherichia coli MS 182-1
MQELPMLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTRDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRFGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 16645 - protein, 365 aa, Escherichia coli MS 182-1; identical to SEQ ID NO: 7931

SEQ ID NO: 16646 - protein, 122 aa, Escherichia coli MS 182-1; identical to SEQ ID NO: 5737

SEQ ID NO: 16647 - protein, 360 aa, Escherichia coli MS 182-1
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVTTAYNGGAGSVLRVFSNDKIQAANIINTMTPGDVYQTLTTRHPSAESRRYLYKVNTAQKSYRRR

SEQ ID NO: 16648 - protein, 236 aa, Escherichia coli MS 182-1; identical to SEQ ID NO: 6643

SEQ ID NO: 16649 - protein, 851 aa, Escherichia coli MS 182-1; identical to SEQ ID NO: 8686

SEQ ID NO: 16650 - protein, 233 aa, Escherichia coli MS 182-1; identical to SEQ ID NO: 6327

SEQ ID NO: 16651 - protein, 362 aa, Escherichia coli MS 182-1; identical to SEQ ID NO: 5809

SEQ ID NO: 16652 - protein, 231 aa, Escherichia coli MS 182-1; identical to SEQ ID NO: 15408

SEQ ID NO: 16653 - protein, 813 aa, Escherichia coli MS 182-1
MVLTGSGMLCTTANAEEYYFDPIMLETTKSGMQATELSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 16654 - protein, 243 aa, Escherichia coli MS 182-1; identical to SEQ ID NO: 6145

SEQ ID NO: 16655 - protein, 230 aa, Escherichia coli MS 182-1; identical to SEQ ID NO: 14528

SEQ ID NO: 16656 - protein, 820 aa, Escherichia coli MS 182-1; identical to SEQ ID NO: 15412

SEQ ID NO: 16657 - protein, 208 aa, Escherichia coli MS 182-1; identical to SEQ ID NO: 5717

SEQ ID NO: 16658 - protein, 245 aa, Escherichia coli MS 182-1
MKMTFMKGLPLLLLVASLCSHAALQPDRTRIVFNANDKATSLRVDNRSDKLPYLAYSWLENEKGEKSDDLLVPLPPIQRLEPKATTQVRIVKQASTTKLPGDRETLFFYNMREIPPAPEKNSDHAVLQVAIQSRIKVFWRPAALRKKAGEKVELQLQVSQQGNQLTLKNPTAYYLTIAYLGRNEKGVLPGFKTVMVAPFSTVNTNTGNYSGSQFYLGYMDDYGALRMTTLNCSGQCHLQAVEAKK

SEQ ID NO: 16659 - protein, 819 aa, Escherichia coli MS 182-1
MDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNISIPQAWLAWHSENWTPPSTWKEGVAGILMDYNLFASSYRPQDGSSSTNLNAYGTTGINAGAWRLRSDYQLNQTDSDDNHEQSGGISRTYLFRPLPQLGSKLTLGETDFSSNIFDGFSYTGAALASDERMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTGWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDGSGISVGMVGEEGHAWLSGVAENQQFTVVWGDSQHCSLHLPEHMEDTANRLILPCH

SEQ ID NO: 16660 - protein, 431 aa, Escherichia coli MS 182-1; identical to SEQ ID NO: 6791

SEQ ID NO: 16661 - protein, 614 aa, Escherichia coli MS 182-1; identical to SEQ ID NO: 6303

SEQ ID NO: 16662 - protein, 524 aa, Escherichia coli MS 182-1
MSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNAVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 16663 - protein, 169 aa, Escherichia coli MS 182-1; identical to SEQ ID NO: 8240

SEQ ID NO: 16664 - protein, 374 aa, Escherichia coli MS 182-1; identical to SEQ ID NO: 5608

SEQ ID NO: 16665 - protein, 219 aa, Escherichia coli MS 182-1; identical to SEQ ID NO: 6490

SEQ ID NO: 16666 - protein, 856 aa, Escherichia coli MS 182-1
MAGFFVRLVVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCIANYQLPPESQQQLLTQLSAECR

SEQ ID NO: 16667 - protein, 241 aa, Escherichia coli MS 182-1; identical to SEQ ID NO: 6138

SEQ ID NO: 16668 - protein, 368 aa, Escherichia coli MS 182-1; identical to SEQ ID NO: 7849

SEQ ID NO: 16669 - protein, 204 aa, Escherichia coli MS 182-1; identical to SEQ ID NO: 5755

SEQ ID NO: 16670 - protein, 386 aa, Escherichia coli MS 182-1; identical to SEQ ID NO: 7993

SEQ ID NO: 16671 - protein, 518 aa, Escherichia coli MS 182-1; identical to SEQ ID NO: 6358

SEQ ID NO: 16672 - protein, 746 aa, Escherichia coli MS 182-1; identical to SEQ ID NO: 6296

SEQ ID NO: 16673 - protein, 883 aa, Escherichia coli MS 182-1; identical to SEQ ID NO: 15417

SEQ ID NO: 16674 - protein, 113 aa, Escherichia coli MS 182-1; identical to SEQ ID NO: 8081

SEQ ID NO: 16675 - protein, 111 aa, Escherichia coli MS 182-1; identical to SEQ ID NO: 7885

SEQ ID NO: 16676 - protein, 353 aa, Escherichia coli MS 185-1; identical to SEQ ID NO: 6846

SEQ ID NO: 16677 - protein, 654 aa, Escherichia coli MS 185-1; identical to SEQ ID NO: 6816

SEQ ID NO: 16678 - protein, 900 aa, Escherichia coli MS 185-1; identical to SEQ ID NO: 6827

SEQ ID NO: 16679 - protein, 679 aa, Escherichia coli MS 185-1
LQGLTTMKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 16680 - protein, 192 aa, Escherichia coli MS 185-1; identical to SEQ ID NO: 16439

SEQ ID NO: 16681 - protein, 721 aa, Escherichia coli MS 185-1; identical to SEQ ID NO: 6807

SEQ ID NO: 16682 - protein, 700 aa, Escherichia coli MS 185-1; identical to SEQ ID NO: 6848

SEQ ID NO: 16683 - protein, 541 aa, Escherichia coli MS 185-1; identical to SEQ ID NO: 15907

SEQ ID NO: 16684 - protein, 656 aa, Escherichia coli MS 185-1; identical to SEQ ID NO: 8223

SEQ ID NO: 16685 - protein, 229 aa, Escherichia coli MS 185-1; identical to SEQ ID NO: 6845

SEQ ID NO: 16686 - protein, 446 aa, Escherichia coli MS 185-1; identical to SEQ ID NO: 5873

SEQ ID NO: 16687 - protein, 518 aa, Escherichia coli MS 185-1; identical to SEQ ID NO: 8246

SEQ ID NO: 16688 - protein, 208 aa, Escherichia coli MS 185-1; identical to SEQ ID NO: 5869

SEQ ID NO: 16689 - protein, 362 aa, Escherichia coli MS 185-1; identical to SEQ ID NO: 5874

SEQ ID NO: 16690 - protein, 204 aa, Escherichia coli MS 185-1; identical to SEQ ID NO: 5755

SEQ ID NO: 16691 - protein, 250 aa, Escherichia coli MS 185-1
MFKAIFTVGSLLLPCIVVAKGIGVTASSNDVVDAQLFSVDLNLNRVVYYHGSLGENVAVKNNQAYPMLVQSMVFDEDKKSPAPFITTPPLFRLDGSQTSRIRIVRTGGEFPQDREKLQWLCVKGIPPQSEDKWAEGTITKNSSFTVQFSVNNCIKVFVRPDTIKGHPEDFADKVTWSKKGTTVLEANNPTPFYLNIKELNIGGRSIKSPNYIPPFGKQSFSIPGSSVGKIQWRIVTDYGGDSKIYQSEGK

SEQ ID NO: 16692 - protein, 850 aa, Escherichia coli MS 185-1
MEERNNKYELSALYIAVLSSLPFFFCADVAARSYTFEPSMLNVDGNDIDLSIFESGAQLPGTYYVDIMLNGKLVDTKEMEFSRERNKDGEFVLSSCLTQSMLNRYGVKVGDYPELFVNSSNGKVCGDLSVIPGAFSYFDFYNQQLNLSIPNVALYPKYKGIASEELWDNGINAFLMNYQANAQINQYRNKKNREVSSYWARIEPGMNIGSWRIRNLTTFTKENGNSEKRESVYTYAERGLTSIKSNLLIGESYTNSDIFDSISFRGIMLHSDESMVPYSKYAFAPVIRGIAQSQALIEVRQNGYLIHTVSVAPGAFEISDLPVTGSGGDLQVSVIETNGKNQSFTVPYTTPVIALRENYLKYSLVGGMYRSAYSGVDNTALIQMTAMYGMPWNLTTFVGFQGSEHYNSVATGVGLSMGDMGAISLDGIYARGQKEKQNKEDGYSWRVRYSKVFDITGTNFIAASHQYSSDGYQTLSDVLDTYGHSNYSYGGYANRSMRNSLTISQSMGEWGTFSFGGVRDEYRGNRSPQNSINALYSNSMEWGTLSLNWSQNKITDSSRSVKDKKENIFSFWVSIPLYRLLGNTSNNINATTQIQKYDNQKMQYEFGMNGRAFNRQLYWDISQRLAPGNENYNDASRLNLEWYGTYGQIRGGYGYSDSLRQMNAGISGTAIVHSNGVTFGQKQGGTIALVEAQGVDGAEVIGWPGVKTDFRGYTALGHLTPYQENTVSLNPASFPEYAEVLQTDTKVIPTKGAVVSARFKTSIGKKALFKLTRHDGKKVPFGAVVSSATADDNKRVVGIVNESGEVYMSGLSEKGQLDVKWNSHGSCKAVYKLSDNKSIVNIYNASLTCI

SEQ ID NO: 16693 - protein, 249 aa, Escherichia coli MS 185-1
MNIMKLPLITTGMICFLGICNFAQATVSPDRTRIIFNASNKSATVRLTNQSKIDPYLAQSWIEDASGKKTRDYISTLPPMERIEPDEQVQIRLMALASLNNLPQDRETLFYYNVREIPPRAKEQNVMQIAMQSRLKLFWRPKAIELKEGEMVPLQKVTITRPAAGLTLNNPTPYHITVGYIGTNGKTLMPGADSIMVAPFASATQHLNNLPSTFQLGFVADYGGLEMFKVVCNSVQSLCQSTPAKKGKI

SEQ ID NO: 16694 - protein, 840 aa, Escherichia coli MS 185-1; identical to SEQ ID NO: 5851

SEQ ID NO: 16695 - protein, 222 aa, Escherichia coli MS 185-1; identical to SEQ ID NO: 5850

SEQ ID NO: 16696 - protein, 713 aa, Escherichia coli MS 185-1; identical to SEQ ID NO: 6056

SEQ ID NO: 16697 - protein, 681 aa, Escherichia coli MS 185-1
MTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 16698 - protein, 368 aa, Escherichia coli MS 185-1; identical to SEQ ID NO: 8204

SEQ ID NO: 16699 - protein, 241 aa, Escherichia coli MS 185-1; identical to SEQ ID NO: 6139

SEQ ID NO: 16700 - protein, 878 aa, Escherichia coli MS 185-1; identical to SEQ ID NO: 6809

SEQ ID NO: 16701 - protein, 784 aa, Escherichia coli MS 185-1; identical to SEQ ID NO: 6829

SEQ ID NO: 16702 - protein, 119 aa, Escherichia coli MS 185-1; identical to SEQ ID NO: 14746

SEQ ID NO: 16703 - protein, 614 aa, Escherichia coli MS 185-1; identical to SEQ ID NO: 5872

SEQ ID NO: 16704 - protein, 831 aa, Escherichia coli MS 185-1
MQELPMLRMTPLASAIVALLIGIEAYAAEETFDTHFMIGGMKDQQVSNIRLEDNQPLPGPYDIDIYVNKQWRGKYEIIVKDNPQETCLSREMIKRLGINTDSFASGKQCLTFKQLIQGGSYTWDIGAFRLDFSVPQAWVEDLESGYVPPENWERGINAFYTSYYVSQYYSDYKASGNSKSTYVRFNSGLNLQGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSIQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 16705 - protein, 222 aa, Escherichia coli MS 185-1
MKGLLALLISSMVLPAHAGIVIYGTRIIYPAEHKEVMVQLMNQGNRSSLMQAWIDDGDTSLPPEKIQVPFMLTPPVAKIGANSGQQVKIMPNKLPTNKESIFYLNVLDIPPNSPEQEGKNALKFAMQNRIKLFYRPAGIAPVNKVTFKKLLVNRSGNGLVIKNDSANWVTISDVKANNVKVNYETIMIAPLESQSVNVKSNNANNWHLTIIDDHGNYINDKI

SEQ ID NO: 16706 - protein, 728 aa, Escherichia coli MS 185-1; identical to SEQ ID NO: 8238

SEQ ID NO: 16707 - protein, 828 aa, Escherichia coli MS 185-1; identical to SEQ ID NO: 6558

SEQ ID NO: 16708 - protein, 169 aa, Escherichia coli MS 185-1; identical to SEQ ID NO: 8240

SEQ ID NO: 16709 - protein, 375 aa, Escherichia coli MS 185-1; identical to SEQ ID NO: 5922

SEQ ID NO: 16710 - protein, 192 aa, Escherichia coli MS 185-1; identical to SEQ ID NO: 7823

SEQ ID NO: 16711 - protein, 274 aa, Escherichia coli MS 185-1; identical to SEQ ID NO: 5899

SEQ ID NO: 16712 - protein, 242 aa, Escherichia coli MS 185-1; identical to SEQ ID NO: 16450

SEQ ID NO: 16713 - protein, 882 aa, Escherichia coli MS 185-1; identical to SEQ ID NO: 8245

SEQ ID NO: 16714 - protein, 241 aa, Escherichia coli MS 185-1; identical to SEQ ID NO: 8229

SEQ ID NO: 16715 - protein, 861 aa, Escherichia coli MS 185-1; identical to SEQ ID NO: 8230

SEQ ID NO: 16716 - protein, 231 aa, Escherichia coli MS 185-1; identical to SEQ ID NO: 6154

SEQ ID NO: 16717 - protein, 890 aa, Escherichia coli MS 185-1
MAADFIFSLSVGADMFFGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQIYMSNQARGYIAPEYWDNGITAALLNYDFSGNRVRDSYGGTSDYAYLNLKTGLNIGSWRLRDNTSWSYSAGKGYSQNNWQHINTWLERDIVPLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRHDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLEDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTVSCR

SEQ ID NO: 16718 - protein, 360 aa, Escherichia coli MS 185-1; identical to SEQ ID NO: 6702

SEQ ID NO: 16719 - protein, 432 aa, Escherichia coli MS 185-1; identical to SEQ ID NO: 5727

SEQ ID NO: 16720 - protein, 746 aa, Escherichia coli MS 185-1
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGVNYIAGAGAYTYNEPGRTWYMSINTHF

SEQ ID NO: 16721 - protein, 161 aa, Escherichia coli MS 185-1; identical to SEQ ID NO: 5769

SEQ ID NO: 16722 - protein, 266 aa, Escherichia coli MS 185-1; identical to SEQ ID NO: 6841

SEQ ID NO: 16723 - protein, 726 aa, Escherichia coli MS 185-1; identical to SEQ ID NO: 16426

SEQ ID NO: 16724 - protein, 230 aa, Escherichia coli MS 185-1; identical to SEQ ID NO: 8200

SEQ ID NO: 16725 - protein, 825 aa, Escherichia coli MS 185-1; identical to SEQ ID NO: 8201

SEQ ID NO: 16726 - protein, 753 aa, Escherichia coli MS 185-1
MNVIKLAIGSGILLLSCGAYSQSISEKTNSDKKGAAEFSPLSVSVGKTTSEQEALEKTGATSSRTTDKNLQSLDATVRSMPGTYTQIDPGQGAISVNIRGMSGFGRVNTMVDGITQSFYGTSTSGTTTHGSTNNMAGVLIDPNLLVAVDVTRGDSSGSEGINALAGSANMRTIGVDDVIFNGNTYGLRSRFSVGSNGLGRSGMIALGGKSDAFTDTGSIGVMAAVSGSSVYSNFSNGSGINSKEFGYDKYMKQNPKSQLYKMDIRPDEFNSFELSARTYENKFTRRDITSDDYYIKYHYTPFSELIDFNVTASTSRGNQKYRDGSLYTFYKTSAQNRSDALDINNTSRFTVADNDLEFMLGSKLMRTRYDRTIHSAAGDPKANQESIENNPFAPSGQQDISALYTGLKVTRGIWEADFNLNYTRNRITGYKPACDSRVICVPQGSYDIDDKEGGFNPSVQLSAQVTPWLQPFIGYSKSMRAPNIQEMFFSNSGGASMNPFLKPERAETWQAGFYIDTRDLLVEQDALRFKALAYRSRIQNYIYSESYLVCSGGRKCSLPEVIGNGWEGISDEYSDNMYIYVNSASDVIAKGFELEMDYDAGFAFGRLSFSQQQTDQPTSIASTHFGAGDITELPRKYMTLDTGVRFFDNALTLGTIIKYTGKARRLSPDFEQDEHTGAIIKQDLPQIPTIIDLYGTYEYNRNLTLKLSVQNLMNRDYSEALNKLNMMPGLGDETHPANSARGRTWIFGGDIRF

SEQ ID NO: 16727 - protein, 111 aa, Escherichia coli MS 185-1; identical to SEQ ID NO: 5889

SEQ ID NO: 16728 - protein, 113 aa, Escherichia coli MS 185-1
MEKDQKNENTLQLAIISRIKMFYRPTHLAMAPEEAPAMLRFRRSGSKLTLINPTPYFITVTNMKAGNSNLPNTMVPPKGEVSVDIPHAVTGDISFQTINDYGALTPRIKATMQ

SEQ ID NO: 16729 - protein, 805 aa, Escherichia coli MS 185-1
MTAFRAAFKVYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDYPQIVLLKLAGASSIMAAQSHRIRLILP

SEQ ID NO: 16730 - protein, 629 aa, Escherichia coli MS 185-1; identical to SEQ ID NO: 16458

SEQ ID NO: 16731 - protein, 250 aa, Escherichia coli MS 185-1; identical to SEQ ID NO: 5862

SEQ ID NO: 16732 - protein, 249 aa, Escherichia coli MS 185-1; identical to SEQ ID NO: 16460

SEQ ID NO: 16733 - protein, 386 aa, Escherichia coli MS 185-1; identical to SEQ ID NO: 16461

SEQ ID NO: 16734 - protein, 774 aa, Escherichia coli MS 185-1; identical to SEQ ID NO: 16243

SEQ ID NO: 16735 - protein, 1024 aa, Escherichia coli MS 185-1
MPTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGSNVSSSELAKASIELINQLVDTAASINNNVNSFSQQLNKLGSVLSNTKHLNGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDHIEGNDGNDRLYGDKGNDTLRGGNGDDQLYGGDGNDKLIGGAGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFRREGNDLIMYKAEGNVLSIGHKNGITFRNWFEKESGDISNHQIEQIFDKDGRVITPDSLKKALEYQQSNNKASYVYGNDALAYGSQDNLNPLINEISKIISAAGNFDVKEERAAASLLQLSGNASDFSYGRNSITLTASA

SEQ ID NO: 16736 - protein, 355 aa, Escherichia coli MS 185-1
MKKLTVAISAVAASVLMAMSAQAAEIYNKDSNKLDLYGKVNAKHYFSSNDADDGDTTYVRLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVG

SEQ ID NO: 16737 - protein, 122 aa, Escherichia coli MS 185-1; identical to SEQ ID NO: 5737

SEQ ID NO: 16738 - protein, 213 aa, Escherichia coli MS 185-1; identical to SEQ ID NO: 5744

SEQ ID NO: 16739 - protein, 729 aa, Escherichia coli MS 185-1; identical to SEQ ID NO: 6821

SEQ ID NO: 16740 - protein, 191 aa, Escherichia coli MS 185-1; identical to SEQ ID NO: 6818

SEQ ID NO: 16741 - protein, 517 aa, Escherichia coli MS 185-1; identical to SEQ ID NO: 6817

SEQ ID NO: 16742 - protein, 760 aa, Escherichia coli MS 185-1; identical to SEQ ID NO: 6793

SEQ ID NO: 16743 - protein, 331 aa, Escherichia coli MS 185-1; identical to SEQ ID NO: 8190

SEQ ID NO: 16744 - protein, 431 aa, Escherichia coli MS 185-1; identical to SEQ ID NO: 6791

SEQ ID NO: 16745 - protein, 719 aa, Escherichia coli MS 185-1
MRDEMLYNIPCRIYILSTLSLCISGIVSTATATSSETKISNEETLVVTTNRSASNLWESPATIQVIGQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWRFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYKTSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 16746 - protein, 478 aa, Escherichia coli MS 185-1; identical to SEQ ID NO: 6796

SEQ ID NO: 16747 - protein, 541 aa, Escherichia coli MS 187-1; identical to SEQ ID NO: 6754

SEQ ID NO: 16748 - protein, 207 aa, Escherichia coli MS 187-1; identical to SEQ ID NO: 5743

SEQ ID NO: 16749 - protein, 554 aa, Escherichia coli MS 187-1; identical to SEQ ID NO: 15864

SEQ ID NO: 16750 - protein, 213 aa, Escherichia coli MS 187-1; identical to SEQ ID NO: 5744

SEQ ID NO: 16751 - protein, 578 aa, Escherichia coli MS 187-1
MALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGIYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 16752 - protein, 235 aa, Escherichia coli MS 187-1; identical to SEQ ID NO: 6404

SEQ ID NO: 16753 - protein, 191 aa, Escherichia coli MS 187-1; identical to SEQ ID NO: 5748

SEQ ID NO: 16754 - protein, 517 aa, Escherichia coli MS 187-1
MKHKLQMMKMRWLSAAVMLTLYTSSSWAFSIDDVAKQAQSLAGKGYETPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNTDQTLSETWSYQLPANE

SEQ ID NO: 16755 - protein, 274 aa, Escherichia coli MS 187-1; identical to SEQ ID NO: 5730

SEQ ID NO: 16756 - protein, 249 aa, Escherichia coli MS 187-1
MTNLFSAKTVATTLALLITATSLQAQASVTPDRTRLIFNESDKSISVTLRNNDPKMPYLAQSWMEDEQGNKISSPLTVLPPVQRIDAMMNGQVKVQGMPDINKLPADRESVFYFNVREIPPKSNKPNTLQIALQTRIKLFWRPKALENVSMKNPWQHKVTLTRSGQEFTVNNPTPYFVVISNASAQKNGNPAAGFSPMVISPKTSVPLKVKMDSVPVLTYVNDYGARMPLYFKCGGDTCQVDVEQSRKG

SEQ ID NO: 16757 - protein, 860 aa, Escherichia coli MS 187-1
MSGSYVNAWAEDEIQFDSRFLELKDDTKIDLKRFSSQGYVEPGKYNLQVQLNKQPLAEEYDIYWYASENDASKTYACLTPELVSQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQMGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDIPHSHTRLDKETAYGKGSLDGNSFRVSYSKDFDELNSRVTFAGYRFSEENFMTMSEYLDASDSEMVRTGNDKEMYTATYNQNFRDAGVSVYLNYTRHTYWDRDEQTNYNVMLSHYFNLGSIRNMSVSMTGYRYEYDNQTDKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQATLTEGAIGYRKFSVISGQKAMAVLRLQDGSHPPFGAEVKNDNAQNVGLVDDDGNVYLAGVKPGEHMIVSWGGVAHCDIHLPDPLPADLFNGLLLPCQQTGAISSPVHNEIKPVIQEQTQQVTPTEPPVSVSAN

SEQ ID NO: 16758 - protein, 784 aa, Escherichia coli MS 187-1; identical to SEQ ID NO: 6283

SEQ ID NO: 16759 - protein, 614 aa, Escherichia coli MS 187-1; identical to SEQ ID NO: 6387

SEQ ID NO: 16760 - protein, 368 aa, Escherichia coli MS 187-1; identical to SEQ ID NO: 7728

SEQ ID NO: 16761 - protein, 241 aa, Escherichia coli MS 187-1; identical to SEQ ID NO: 6136

SEQ ID NO: 16762 - protein, 590 aa, Escherichia coli MS 187-1
MLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGIYGTLLEDNDLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 16763 - protein, 122 aa, Escherichia coli MS 187-1; identical to SEQ ID NO: 5737

SEQ ID NO: 16764 - protein, 700 aa, Escherichia coli MS 187-1
MKIFSVRQTVLPALLALSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMTPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDADVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 16765 - protein, 360 aa, Escherichia coli MS 187-1
MKKLTVAISAVAASVLMAMSAQAAEIYNKDSNKLDLYGKVNAKHYFSSYDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTDGQVAYGKSKFNASGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 16766 - protein, 869 aa, Escherichia coli MS 187-1; identical to SEQ ID NO: 6711

SEQ ID NO: 16767 - protein, 230 aa, Escherichia coli MS 187-1
MMTKIKLLMLIIFYLIISASAHAAGGIALGATRIIYPADAKQTAVWIRNSHTNERFLVNSWIENSSGVKKKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 16768 - protein, 760 aa, Escherichia coli MS 187-1; identical to SEQ ID NO: 6703

SEQ ID NO: 16769 - protein, 331 aa, Escherichia coli MS 187-1; identical to SEQ ID NO: 6551

SEQ ID NO: 16770 - protein, 431 aa, Escherichia coli MS 187-1; identical to SEQ ID NO: 6791

SEQ ID NO: 16771 - protein, 803 aa, Escherichia coli MS 187-1
MAMPCALAVEFNLNVLDKSMRDRIDISLLKEKGVIAPGEYFVSVAVNNNQISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASNYRPQDGSSSTNLNAYGTTGINAGSWRLRSDYQLNNTDSEDSHEQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITSLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 16772 - protein, 245 aa, Escherichia coli MS 187-1
MKMTFMKGLPLLLLVASLCSHAALQPDRTRIVFNANDKATSLRVDNRSDKLPYLAYSWLENEKGEKSDDLLVALPPIQRLEPKATTQVRIVKQASTAKLPGDRETLFFYNMREIPPAPEKNSDHAVLQVAIQSRIKVFWRPAALRKKAGEKVELQLQVSQQGNQLTLKNPTAYYLTIAYLGRNEKGVFPGFKTVMIAPFSTVNTNTGSYSGSQFYLGYMDDYGALRMTTLNCSGECRLQAVEAKK

SEQ ID NO: 16773 - protein, 353 aa, Escherichia coli MS 187-1; identical to SEQ ID NO: 15872

SEQ ID NO: 16774 - protein, 204 aa, Escherichia coli MS 187-1; identical to SEQ ID NO: 5755

SEQ ID NO: 16775 - protein, 362 aa, Escherichia coli MS 187-1; identical to SEQ ID NO: 5809

SEQ ID NO: 16776 - protein, 233 aa, Escherichia coli MS 187-1; identical to SEQ ID NO: 6411

SEQ ID NO: 16777 - protein, 851 aa, Escherichia coli MS 187-1; identical to SEQ ID NO: 7706

SEQ ID NO: 16778 - protein, 236 aa, Escherichia coli MS 187-1; identical to SEQ ID NO: 6409

SEQ ID NO: 16779 - protein, 446 aa, Escherichia coli MS 187-1 [sequence omitted]

SEQ ID NO: 16780 - protein, 813 aa, Escherichia coli MS 187-1; identical to SEQ ID NO: 16008

SEQ ID NO: 16781 - protein, 360 aa, Escherichia coli MS 187-1
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGIDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 16782 - protein, 510 aa, Escherichia coli MS 187-1; identical to SEQ ID NO: 6653

SEQ ID NO: 16783 - protein, 663 aa, Escherichia coli MS 187-1; identical to SEQ ID NO: 6666

SEQ ID NO: 16784 - protein, 169 aa, Escherichia coli MS 187-1; identical to SEQ ID NO: 15504

SEQ ID NO: 16785 - protein, 478 aa, Escherichia coli MS 187-1; identical to SEQ ID NO: 5711

SEQ ID NO: 16786 - protein, 774 aa, Escherichia coli MS 187-1; identical to SEQ ID NO: 6382

SEQ ID NO: 16787 - protein, 239 aa, Escherichia coli MS 187-1; identical to SEQ ID NO: 6428

SEQ ID NO: 16788 - protein, 831 aa, Escherichia coli MS 187-1
MQELPMLRMTPLASAIVALLLGIEAYAAEETFDTHFMIGGMKDQQVANIRLDDNQPLPGQYDIDIYVNKQWRGKYEIIVKDTPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDLAAGRSHIEGASKQSDFVQAGYQYGFNNLLTLYGGSMVANNYYAFTLGAGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQSLTFGYEVNDIHGHNIGVVGQGSQLFIRTNEVPPSVNVAIDKQQGLSCTITFGKEIDKSRNYICQ

SEQ ID NO: 16789 - protein, 386 aa, Escherichia coli MS 187-1; identical to SEQ ID NO: 7908

SEQ ID NO: 16790 - protein, 432 aa, Escherichia coli MS 187-1; identical to SEQ ID NO: 5727

SEQ ID NO: 16791 - protein, 219 aa, Escherichia coli MS 187-1
MSLNFTVIVWLRLSIGGVYVLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKDLQRKAPDKNIVIFTHNHCLTYIAKDKRDATFKPDYLDGLVMHVEKGKVYLDGEFVNH

SEQ ID NO: 16792 - protein, 367 aa, Escherichia coli MS 187-1
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGNPSGEGFTSGVTNNGRDALRQNGDGVGGSITYDYEGFGIGGAISSSKRTDAQNTAAYIGNGDRAETYTGGLKYDANNIYLAAQYTQTYNATRVGSLGWANKAQNFEAVAQYQFDFGLCPSLAYLQSKGKNLGRGYDDEDILKYVDVGATYYFNKNMSTYVDYKINLLDDNQFTRDAGIDTDNIVALGLVYQF

SEQ ID NO: 16793 - protein, 746 aa, Escherichia coli MS 187-1
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWGAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 16794 - protein, 208 aa, Escherichia coli MS 187-1; identical to SEQ ID NO: 5717

SEQ ID NO: 16795 - protein, 230 aa, Escherichia coli MS 187-1; identical to SEQ ID NO: 7855

SEQ ID NO: 16796 - protein, 825 aa, Escherichia coli MS 187-1
MGQNASNIDLSRYSEGNPAIPGMYDLSVYVNDQPIINQSITFIEIEGKKNAQACITLKNLLQFHINSPDINNEKAVLLARDETLGNCLNLTKIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 16797 - protein, 686 aa, Escherichia coli MS 187-1; identical to SEQ ID NO: 6339

SEQ ID NO: 16798 - protein, 834 aa, Escherichia coli MS 187-1
MYKKLKLTTISELIKNIYCSLSVIIIGCASAYAVEFNKDLIEAEDRENVNLSQFETDGQLPVGKYSLSTLINNKRTPIHLDLQWVLIDNLTAVCVTPEQLTLLGFTDEFIEKTQQTLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEDDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTVILPCISQN

SEQ ID NO: 16799 - protein, 252 aa, Escherichia coli MS 187-1
MKLMRYLNTKNIIAAGVLLSCMSSIAWGAIIPDRTRIIMNESDKGEALKLTNQSKNLPYLAQTWIEDTKGNKSRDFIVTVPPMVRLNPSEQIQIRMITQKKIAQLPKDRETLFYFNVREIPPKTDKKNVMQVTMQHALKLFWRPKAIELEDDGVMTYEKVEIIRRNDGSIRFNNKMPYHVTLGYIGTNGVTMLPQTQSLMVTPFSHANTQFKNVPSTFQVGYINDFGGLSFYEINCPVVNNICNISVAKRDQ

SEQ ID NO: 16800 - protein, 747 aa, Escherichia coli MS 187-1; identical to SEQ ID NO: 6511

SEQ ID NO: 16801 - protein, 266 aa, Escherichia coli MS 187-1; identical to SEQ ID NO: 5772

SEQ ID NO: 16802 - protein, 161 aa, Escherichia coli MS 187-1; identical to SEQ ID NO: 5769

SEQ ID NO: 16803 - protein, 650 aa, Escherichia coli MS 187-1; identical to SEQ ID NO: 6393

SEQ ID NO: 16804 - protein, 897 aa, Escherichia coli MS 187-1; identical to SEQ ID NO: 6749

SEQ ID NO: 16805 - protein, 539 aa, Escherichia coli MS 196-1; identical to SEQ ID NO: 6391

SEQ ID NO: 16806 - protein, 859 aa, Escherichia coli MS 196-1
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKSNDASNPWRYVRAATATEISETSNPQSCTSAPQPSPDVKPAPDVKPAPDVQPAPADKSNDNYAVVAWKGQEGSSTWYVIYNGGIYKNAWWVGAANCPGDAKENDASNPWRYVRAATATEISQYGNPGSCSVKPDNNGGAVTPVDPTPETPVTPTPDNSEPSTPADSVNDYSLQAWSGQEGSEIYHVIFNGNVYKNAWWVGSKDCPRGTSAENSNNPWRLERTATAAELSQYGNPTTCEIDNGGVIVADGFQASKAYSADSIVDYNDAHYKTSVDQDAWGFVPGGDNPWKKYEPAKAWSASTVYVKGDRVVVDGQAYEALFWTQSDNPALVANQNATGSNSRPWKPLGKAQSYSNEELNNAPQFNPETLYASDTLIRFNGVNYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLKVLDFDIEGTWVADQASIERRNLAVKKVQDKWKSEGKDIAIWYTLPILPTGLTPEGMNVLSDAKAKGVELAGVNVMTMNYGNAICQSANTEGQNIHGKCATSAIANLHSQLKGLHPNKSDAEIDAMMGTTPMVGVNDVQGEVFYLSDARLVMQDAQKRNLGMVGIWS

SEQ ID NO: 16807 - protein, 360 aa, Escherichia coli MS 196-1
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSATYEYEGFGVGATYAKSDRTDGQVAYGKSKFNASGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 16808 - protein, 351 aa, Escherichia coli MS 196-1; identical to SEQ ID NO: 14443

SEQ ID NO: 16809 - protein, 446 aa, Escherichia coli MS 196-1 [sequence omitted]

SEQ ID NO: 16810 - protein, 478 aa, Escherichia coli MS 196-1; identical to SEQ ID NO: 5711

SEQ ID NO: 16811 - protein, 856 aa, Escherichia coli MS 196-1
MAGFFVRLVVACAFAAQAPLSSADLYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKVPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 16812 - protein, 218 aa, Escherichia coli MS 196-1
MFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 16813 - protein, 368 aa, Escherichia coli MS 196-1; identical to SEQ ID NO: 6380

SEQ ID NO: 16814 - protein, 686 aa, Escherichia coli MS 196-1; identical to SEQ ID NO: 6795

SEQ ID NO: 16815 - protein, 689 aa, Escherichia coli MS 196-1
MIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYGDNQARVTAYDATTGTLTRRVDATQGSTQRMHSTRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 16816 - protein, 673 aa, Escherichia coli MS 196-1; identical to SEQ ID NO: 6170

SEQ ID NO: 16817 - protein, 654 aa, Escherichia coli MS 196-1
MDCVMKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGLTSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 16818 - protein, 222 aa, Escherichia coli MS 196-1
MSKLGISSLFKSILLTAALAVSFTASAFTEGTDYMVLEKPIPNADKTLIKVFSYACPFCYKYDKAVTGPVSEKVKDIVAFTPFHLETKGEYGKQASEVFAVLINKDKAAGISLFDANSQFKKAKFAYYAAYHDKKERWSDGKDPAAFIKTGLDAAGMSQADFEAALKEPAVQETLEKWKASYEVAKIQGVPAYVVNGKYLIYTKSIKSIDSMADLIRELASK

SEQ ID NO: 16819 - protein, 518 aa, Escherichia coli MS 196-1; identical to SEQ ID NO: 6358

SEQ ID NO: 16820 - protein, 362 aa, Escherichia coli MS 196-1; identical to SEQ ID NO: 5809

SEQ ID NO: 16821 - protein, 224 aa, Escherichia coli MS 196-1; identical to SEQ ID NO: 7705

SEQ ID NO: 16822 - protein, 851 aa, Escherichia coli MS 196-1; identical to SEQ ID NO: 14331

SEQ ID NO: 16823 - protein, 229 aa, Escherichia coli MS 196-1; identical to SEQ ID NO: 7707

SEQ ID NO: 16824 - protein, 867 aa, Escherichia coli MS 196-1; identical to SEQ ID NO: 6359

SEQ ID NO: 16825 - protein, 230 aa, Escherichia coli MS 196-1; identical to SEQ ID NO: 6360

SEQ ID NO: 16826 - protein, 389 aa, Escherichia coli MS 196-1
MTLMVDDVPVAQVLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 16827 - protein, 714 aa, Escherichia coli MS 196-1
MAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 16828 - protein, 274 aa, Escherichia coli MS 196-1; identical to SEQ ID NO: 6362

SEQ ID NO: 16829 - protein, 250 aa, Escherichia coli MS 196-1; identical to SEQ ID NO: 6361

SEQ ID NO: 16830 - protein, 881 aa, Escherichia coli MS 196-1
MPDHSLFRLRILPWCIALAMSGSYSSVWAEDDIQFDSRFLELKGDTKIDLKRFSSQGYVEPGKYNLQVQLNKQPLAEEYDIYWYAGEDDVSKSYACLTPELVAQFGLKEDVAKNLQWSHDGKCLKPGQLEGVEIKADLSQSALVISLPQAYLEYTWPDWDPPSRWDDGISGIIADYSITAQTRHEENGGDDSNEISGNGTVGVNLGPWRMRADWQTNYQHTRSNDDDDEFGGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGGFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSIVSYNGNYGSGTDSSQVGYFSRVDDATHYQLNIGTSDKHTSVDGYYSHDGSLAQVDLSANYHEGQYTSAGLSLQGGATLTTHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGSVYLAGVKPGEHMSVFWSGVAHCDINLPDPLPADLFNGLLLPCQHKGNVAPVVPDDIKPVIQEQTQQVTPTDPPVSVSANQ

SEQ ID NO: 16831 - protein, 614 aa, Escherichia coli MS 196-1; identical to SEQ ID NO: 6387

SEQ ID NO: 16832 - protein, 367 aa, Escherichia coli MS 196-1; identical to SEQ ID NO: 5789

SEQ ID NO: 16833 - protein, 162 aa, Escherichia coli MS 196-1; identical to SEQ ID NO: 6365

SEQ ID NO: 16834 - protein, 641 aa, Escherichia coli MS 196-1; identical to SEQ ID NO: 7667

SEQ ID NO: 16835 - protein, 203 aa, Escherichia coli MS 196-1; identical to SEQ ID NO: 6414

SEQ ID NO: 16836 - protein, 332 aa, Escherichia coli MS 196-1; identical to SEQ ID NO: 5757

SEQ ID NO: 16837 - protein, 671 aa, Escherichia coli MS 196-1
VSCLTDWHYPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLMNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 16838 - protein, 696 aa, Escherichia coli MS 196-1
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASEQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTVGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSINDNTNSYVNSGKARLHGVEFAGTLPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 16839 - protein, 816 aa, Escherichia coli MS 196-1; identical to SEQ ID NO: 14499

SEQ ID NO: 16840 - protein, 227 aa, Escherichia coli MS 196-1; identical to SEQ ID NO: 8025

SEQ ID NO: 16841 - protein, 784 aa, Escherichia coli MS 196-1; identical to SEQ ID NO: 6283

SEQ ID NO: 16842 - protein, 122 aa, Escherichia coli MS 196-1; identical to SEQ ID NO: 5737

SEQ ID NO: 16843 - protein, 806 aa, Escherichia coli MS 196-1
MLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQQLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVSAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 16844 - protein, 199 aa, Escherichia coli MS 196-1; identical to SEQ ID NO: 8009

SEQ ID NO: 16845 - protein, 432 aa, Escherichia coli MS 196-1; identical to SEQ ID NO: 5727

SEQ ID NO: 16846 - protein, 331 aa, Escherichia coli MS 196-1
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAGPN

SEQ ID NO: 16847 - protein, 224 aa, Escherichia coli MS 196-1; identical to SEQ ID NO: 6372

SEQ ID NO: 16848 - protein, 200 aa, Escherichia coli MS 196-1; identical to SEQ ID NO: 6363

SEQ ID NO: 16849 - protein, 431 aa, Escherichia coli MS 196-1; identical to SEQ ID NO: 6791

SEQ ID NO: 16850 - protein, 815 aa, Escherichia coli MS 196-1
MNIYRLSFVSCLVMAMPCAMAVEFNLNVLDKSMRDRIDISLLKEKGVIAPGEYFVSVAVNNNKISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASSYRPQDGSSSTNLNAYGTAGINAGAWRLRSDYQLNKTDSEDNHDQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISDDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTIHRMSWNDTLDERNSWGMSAGLQSDHPDNGAQVSGNYQHLSSAGEWDISGTYAASDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQLFTVVWGEQSCIIHLPERLEDTTKRLILPCH

SEQ ID NO: 16851 - protein, 242 aa, Escherichia coli MS 196-1; identical to SEQ ID NO: 6420

SEQ ID NO: 16852 - protein, 359 aa, Escherichia coli MS 196-1
MKKYLVLALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPGSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 16853 - protein, 208 aa, Escherichia coli MS 196-1; identical to SEQ ID NO: 5717

SEQ ID NO: 16854 - protein, 865 aa, Escherichia coli MS 196-1; identical to SEQ ID NO: 6375

SEQ ID NO: 16855 - protein, 246 aa, Escherichia coli MS 196-1; identical to SEQ ID NO: 6964

SEQ ID NO: 16856 - protein, 712 aa, Escherichia coli MS 196-1
MSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQ

SEQ ID NO: 16857 - protein, 266 aa, Escherichia coli MS 196-1; identical to SEQ ID NO: 5772

SEQ ID NO: 16858 - protein, 161 aa, Escherichia coli MS 196-1; identical to SEQ ID NO: 5769

SEQ ID NO: 16859 - protein, 793 aa, Escherichia coli MS 196-1
MLKKTLLAYTIGFAFSPPANADGIEIAAVDFDRETLKSLGVDPNISHYFSRSARFLPGEYSLIVSVNGEKKGNIATRFDENGDICLDQAFLQQAGLKIPSEEKNGCYDYILSYPGTTITPLPNQEALDIIVSPQAIIPIGLDLTNAATGGTAALLNYSLMSSRAEFSNGSSDYSQAALEGGININDWMLRSHHFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRVDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFAIAKMDNNIAGVRITSQAGPVWTDFRGNAVIPSIQPWRTSGVEIDTASLPKNVDIGNGTKMIKQGRGAVGKVGFSAITQRRALLNITLSDGKKLPRGVAIEDSEGNYLTTSVDDGVVFLNNIKPDMVLDIKDEQQSCRIHLTFPEDAPKDVFYETATGECQ

SEQ ID NO: 16860 - protein, 628 aa, Escherichia coli MS 196-1; identical to SEQ ID NO: 5802

SEQ ID NO: 16861 - protein, 746 aa, Escherichia coli MS 196-1; identical to SEQ ID NO: 6710

SEQ ID NO: 16862 - protein, 119 aa, Escherichia coli MS 196-1
MNTVLSVQGASAPVENKSFFSKFTRLNMLRLVRAVIPVAVLMMLFPELAMAAGKGDLMAKGNDTVKATFGKDSSIVKWVVLAEVLVGAVMYMMTKNVKFLVGFAIISVFIAVGMSVVGL

SEQ ID NO: 16863 - protein, 700 aa, Escherichia coli MS 196-1; identical to SEQ ID NO: 6388

SEQ ID NO: 16864 - protein, 111 aa, Escherichia coli MS 196-1; identical to SEQ ID NO: 8122

SEQ ID NO: 16865 - protein, 207 aa, Escherichia coli MS 196-1; identical to SEQ ID NO: 5743

SEQ ID NO: 16866 - protein, 565 aa, Escherichia coli MS 196-1; identical to SEQ ID NO: 6395

SEQ ID NO: 16867 - protein, 213 aa, Escherichia coli MS 196-1; identical to SEQ ID NO: 5744

SEQ ID NO: 16868 - protein, 729 aa, Escherichia coli MS 196-1; identical to SEQ ID NO: 6402

SEQ ID NO: 16869 - protein, 191 aa, Escherichia coli MS 196-1; identical to SEQ ID NO: 5748

SEQ ID NO: 16870 - protein, 517 aa, Escherichia coli MS 196-1; identical to SEQ ID NO: 6406

SEQ ID NO: 16871 - protein, 774 aa, Escherichia coli MS 196-1; identical to SEQ ID NO: 7975

SEQ ID NO: 16872 - protein, 732 aa, Escherichia coli MS 198-1; identical to SEQ ID NO: 14794

SEQ ID NO: 16873 - protein, 353 aa, Escherichia coli MS 198-1; identical to SEQ ID NO: 15872

SEQ ID NO: 16874 - protein, 856 aa, Escherichia coli MS 198-1; identical to SEQ ID NO: 16392

SEQ ID NO: 16875 - protein, 241 aa, Escherichia coli MS 198-1; identical to SEQ ID NO: 6143

SEQ ID NO: 16876 - protein, 368 aa, Escherichia coli MS 198-1; identical to SEQ ID NO: 6380

SEQ ID NO: 16877 - protein, 753 aa, Escherichia coli MS 198-1; identical to SEQ ID NO: 5801

SEQ ID NO: 16878 - protein, 224 aa, Escherichia coli MS 198-1
MATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 16879 - protein, 883 aa, Escherichia coli MS 198-1; identical to SEQ ID NO: 14848

SEQ ID NO: 16880 - protein, 243 aa, Escherichia coli MS 198-1; identical to SEQ ID NO: 14800

SEQ ID NO: 16881 - protein, 567 aa, Escherichia coli MS 198-1; identical to SEQ ID NO: 6075

SEQ ID NO: 16882 - protein, 614 aa, Escherichia coli MS 198-1; identical to SEQ ID NO: 14804

SEQ ID NO: 16883 - protein, 204 aa, Escherichia coli MS 198-1; identical to SEQ ID NO: 5755

SEQ ID NO: 16884 - protein, 656 aa, Escherichia coli MS 198-1; identical to SEQ ID NO: 14767

SEQ ID NO: 16885 - protein, 207 aa, Escherichia coli MS 198-1; identical to SEQ ID NO: 5743

SEQ ID NO: 16886 - protein, 366 aa, Escherichia coli MS 198-1; identical to SEQ ID NO: 7432

SEQ ID NO: 16887 - protein, 816 aa, Escherichia coli MS 198-1; identical to SEQ ID NO: 14730

SEQ ID NO: 16888 - protein, 219 aa, Escherichia coli MS 198-1
MSFFILPVHAGVVIYGTRIIYPEKNREVLVQLMNQSKNASLIQAWIDDGNTTIAPEKIQVPFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSNNDITLKNNHASEYELTVVDDYGNNIHSKIAAR

SEQ ID NO: 16889 - protein, 729 aa, Escherichia coli MS 198-1; identical to SEQ ID NO: 8069

SEQ ID NO: 16890 - protein, 213 aa, Escherichia coli MS 198-1; identical to SEQ ID NO: 5744

SEQ ID NO: 16891 - protein, 208 aa, Escherichia coli MS 198-1; identical to SEQ ID NO: 5717

SEQ ID NO: 16892 - protein, 219 aa, Escherichia coli MS 198-1; identical to SEQ ID NO: 15738

SEQ ID NO: 16893 - protein, 274 aa, Escherichia coli MS 198-1; identical to SEQ ID NO: 8098

SEQ ID NO: 16894 - protein, 249 aa, Escherichia coli MS 198-1; identical to SEQ ID NO: 8118

SEQ ID NO: 16895 - protein, 883 aa, Escherichia coli MS 198-1
MDTPMPEHSFLRLRGLSWWIALAISGSPFNALADDTIQFDGRFLDLKGNTKIDLGRFSQKGYVEPGKYNLRVHVNNQPLPDDYDIYWYATENDPNKSYACLSPELVAQFGLKEDIAKNLQWIRDGQCLNTALLAGTEISGDLGQSALLVSVPQAYLEYTDSEWDPPSRWDDGIPGLIADYSINAQTRHENGGDDTNDISGNGTVGVNVGPWRLRADWQSDYQHTRSNDDGDTDDSGTQKNWEWSRYYAWRALPSLKAKLSLGEDYLNSDIFDGFSYIGGSISTDDQMLPPNLRGYAPDISGVAHTTAKVTVTQMGRVIYETQVPAGPFRIQDIGDSVSGTLHVRIEEQNGQVQEYDVSTASMPFLTRPGQVRYKVTMGRPQNWDHQVAGSFFSGGEASWGIANGWSLYGGALADENYQSAALGLGRDLALLGALAFDVTHSRVQLDDNSVYGNKTLDGNSYRVSYAKDFDELNSRVTFAGYRFSEKNYMTMSEYLDANDDDRARTGNDKEMYTVTYNQNFTDARVSVYLNYSHHTYWDRQDQTNYNMMLSHYFNLGSLRNLSVSLTGYRYEYDKSADKGVYLSLSLPWGDNSTISYNGNYGSGADSNQVSLYHRIDDASHYTVSAGTSENHSSVDGYYSHDGTLAKVDLSANYHEGQYTSAGISLQGGATLTAHGGALHRTQNMGGTRLLIDADGVANVPVEGNGSAVYTNMFGKAVVADVNDYYRNQAYIDLNKLPENAEATKSVVQATLTEGAIGYRKFAVISGEKAMAVLRLQDGSHPPFGAEVKNDNQQQVGLVDDEGNVYLAGVKPGEHMTVFWEGESHCDISLPDPLPNDLFNGLLLPCQQKGGSSPVIPHDIQPVIQEQTQQVTPMEPPMSVSSNQ

SEQ ID NO: 16896 - protein, 656 aa, Escherichia coli MS 198-1; identical to SEQ ID NO: 7573

SEQ ID NO: 16897 - protein, 869 aa, Escherichia coli MS 198-1; identical to SEQ ID NO: 14750

SEQ ID NO: 16898 - protein, 230 aa, Escherichia coli MS 198-1; identical to SEQ ID NO: 14749

SEQ ID NO: 16899 - protein, 478 aa, Escherichia coli MS 198-1; identical to SEQ ID NO: 14741

SEQ ID NO: 16900 - protein, 281 aa, Escherichia coli MS 198-1
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLQSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNV

SEQ ID NO: 16901 - protein, 367 aa, Escherichia coli MS 198-1; identical to SEQ ID NO: 14784

SEQ ID NO: 16902 - protein, 169 aa, Escherichia coli MS 198-1; identical to SEQ ID NO: 8240

SEQ ID NO: 16903 - protein, 659 aa, Escherichia coli MS 198-1; identical to SEQ ID NO: 14780

SEQ ID NO: 16904 - protein, 432 aa, Escherichia coli MS 198-1; identical to SEQ ID NO: 5727

SEQ ID NO: 16905 - protein, 613 aa, Escherichia coli MS 198-1
MMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGTRLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 16906 - protein, 331 aa, Escherichia coli MS 198-1; identical to SEQ ID NO: 6551

SEQ ID NO: 16907 - protein, 733 aa, Escherichia coli MS 198-1
MAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKIKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGMAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 16908 - protein, 518 aa, Escherichia coli MS 198-1; identical to SEQ ID NO: 6358

SEQ ID NO: 16909 - protein, 774 aa, Escherichia coli MS 198-1; identical to SEQ ID NO: 6382

SEQ ID NO: 16910 - protein, 250 aa, Escherichia coli MS 198-1; identical to SEQ ID NO: 6119

SEQ ID NO: 16911 - protein, 250 aa, Escherichia coli MS 198-1
MINVLICILICCTNAQAGVVVGGTRFVYPEKQSSISVELKNTASKDMLVKISVTPDDGRQLKGTLESQPLLPDKAFIATPPLLVLKQDKNTKIRINRVGGQLPIDRESLFILNIAVLPAQEQNSQLKNENQLQVAVRNRMKIFYRPETLSGNPLDAYQQLRWSRNNEAVTVFNPTPWYVTLYNLSIDGKSINGGMVAPFSHRQQDWCQRQGYCEINWQTLDLYNNALPVWSVKLNVLQNNAIMGAVAIHG

SEQ ID NO: 16912 - protein, 386 aa, Escherichia coli MS 198-1
MVDDVPVAQVLQALAEQEKLNLVVSPDVRGTVSLHLTDVPWKQALQTVVKSAGLITRQEGNILSVHSVAWQNDNIARQEAEQARAQANLPLENRNITLQYADAGELAKAGEKLLSAKGSMTVDKRTNRLLLRDNKAALSALEQWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 16913 - protein, 669 aa, Escherichia coli MS 198-1; identical to SEQ ID NO: 5950

SEQ ID NO: 16914 - protein, 122 aa, Escherichia coli MS 198-1; identical to SEQ ID NO: 5737

SEQ ID NO: 16915 - protein, 836 aa, Escherichia coli MS 198-1; identical to SEQ ID NO: 6189

SEQ ID NO: 16916 - protein, 244 aa, Escherichia coli MS 198-1; identical to SEQ ID NO: 6219

SEQ ID NO: 16917 - protein, 517 aa, Escherichia coli MS 198-1; identical to SEQ ID NO: 6817

SEQ ID NO: 16918 - protein, 191 aa, Escherichia coli MS 198-1; identical to SEQ ID NO: 14762

SEQ ID NO: 16919 - protein, 235 aa, Escherichia coli MS 198-1; identical to SEQ ID NO: 6404

SEQ ID NO: 16920 - protein, 237 aa, Escherichia coli MS 198-1; identical to SEQ ID NO: 6384

SEQ ID NO: 16921 - protein, 446 aa, Escherichia coli MS 198-1; identical to SEQ ID NO: 6459

SEQ ID NO: 16922 - protein, 753 aa, Escherichia coli MS 198-1
MGMVIIIFSNVEHFLPLRLQFSQLLNVSCRFVFHIFTILLPWRRFPILNLAFFMKIFSVRQTVLPALLVLSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVITQTGQRPPTIEASSYYGSFGSWRYGLKATGAMGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQAAELAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGMNIAWRFE

SEQ ID NO: 16923 - protein, 541 aa, Escherichia coli MS 198-1; identical to SEQ ID NO: 6286

SEQ ID NO: 16924 - protein, 673 aa, Escherichia coli MS 198-1; identical to SEQ ID NO: 8416

SEQ ID NO: 16925 - protein, 686 aa, Escherichia coli MS 198-1; identical to SEQ ID NO: 15667

SEQ ID NO: 16926 - protein, 243 aa, Escherichia coli MS 198-1; identical to SEQ ID NO: 14754

SEQ ID NO: 16927 - protein, 819 aa, Escherichia coli MS 198-1
MDTVNIYRLSFISCLVMAIPSALAVEFNLNVLDKSMRDRIDISLLKGKGGIAPGEYFVSVAVNNNQISNGQKIDWKKNGDQTIPCINDLLVDKFGLKPEVRQSLPRLNQCVDFSSRPEILFIFDQASQQLNITIPQAWLAWHSDNWTPPSTWKEGVAGVLMDYNLFASSYRPQDGSNSTNLNAYGTAGINAGAWRLRSDYQLNQTDSDDNHEQSGEISRTYLFRPLPQLGSKLTLGETDFSSNIFDGFSYTGAALASDDRMLPWELRGYAPQISGIAQTNATVTVSHSGRVIYQKKVPPGPFIIDDLNQSVQGTLDVKVTEEDGRVNNFQVSAASTPFLTRQGQVRYKLAAGQPRTSMSHQTENETFFSNEVSWGMLSNTSLYGGLLISGDNYHSAAMGIGQNMLWLGALSFDVTWASSQFDTQQDERGLSYRFNYSKQVDATNSTISLAAYRFSDRHFHSYANYLDHKYNDNDAQDEKQTISLSVGQPITPLNLNLYANLLHQTWWNADASTTANITAGFNVDIGNWRDISISTSFNTTHYEDKDRDNQIYLSISLPFGNGGRVGYDMQNSNHSTTHRMSWNDTLDERNSWGMSTGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVADNVIKETWIEGAIGYKSLASRSGKDVNLIIRNASGQFPPLGADIRQEDSGISVGMVGEEGHAWLSGVAENQQFTVIWGDSQRCSIHLPEHMEDTANRLILPCH

SEQ ID NO: 16928 - protein, 431 aa, Escherichia coli MS 198-1; identical to SEQ ID NO: 6791

SEQ ID NO: 16929 - protein, 161 aa, Escherichia coli MS 198-1; identical to SEQ ID NO: 5769

SEQ ID NO: 16930 - protein, 266 aa, Escherichia coli MS 198-1; identical to SEQ ID NO: 8089

SEQ ID NO: 16931 - protein, 752 aa, Escherichia coli MS 198-1; identical to SEQ ID NO: 7439

SEQ ID NO: 16932 - protein, 228 aa, Escherichia coli MS 198-1
MAFSMPVMADIVISGTRVIYKSDQKSVSVRLENKGNSHLLVQSWLDTGDDNAEPGSINVPFTATPPVSRIDAKRGQTIKLMYTGSTVLPSDKESVFWFNVLEVPPKPDASKVENQSLLQLAFRTRIKLFYRPAGLNGNPSEAPLALKWKWAEGKSGLSVYNPTSYYVSFNSAELIAGGKSNPLNVKMVAPKSEEIFTISGSGGKATSGKVHFSAINDFGGAIEGDVNL

SEQ ID NO: 16933 - protein, 891 aa, Escherichia coli MS 198-1
MILAAQLKAMSICKTRDLMQQEANVMKTKTSTKRHNLTRIAMYCSIMYSGATIGAESVEYDPTFLMGGNASSIDVSRYSDGNPTLPGVYDVSIYVNEQPVANLEIPFIAIPDKKNAQACITLKNLLQLHIKTPPADEENTILLPRDETLGNCLDLSLAIPKSSVNYDPSEQRLDINVPQAWVMKNYQNYVDPSLWENGINAATLSYNINAYRSENSNYTNDSVYTSFNGGVNLGAWRLRSSGNYSWRNDAGSNVEFMNRYVQRDITAIRSQLIMGESYTTGETFDSVSIRGIRLYSDSRMLPPVLANFAPTIRGVANTNAKVSITQSGYKIYETTVPPGPFVIDDLSPSGYGSDLIVTIEEADGSKRTFSQPFSSVIQMLRPGVSRWDISGGQINKDDLHHEPNLLQATYYRGLSNLFTGYTGFQVTDNHYAAGLLGIGMNTSVGAISFDVTHSSVDIPDDKRYQGQSYRISWNKFFDLTDTSLNIAAYRYSTQDYLGLNDALTLIDEVEHPTQDLDPKTMRNYGRMKNQFTVSINQPLRFGKDDYGSFYTSGSWSDYWGGSKSRSNYSVGYSNSASWGSYSISAQRSWDEYSQTENSIYLSFSIPIEKLMGTEHRDSGFQSIDTQLSTNMDGNNQFNMSSSGYSNDNRVSYSVNAGYGMNKTGKDLSNIGGYASYESPWGTLAGSVSATSDNNRQYSVNTDGGFVLHSGGLTFSNDSFSDNDTIALVKAPGAKGARINYGNNTVDRWGYGVTSALSPYQENKIALDTENLENDIEMKSTSTVAVPRQGSVIFAGFETNQGQSAIMNIKRSDGKGIPFAADIHDETNAIIGNVGQGGQAFVRGIQQQGTIKITWLEASMPKTCIAQYQQPNVTSEKIQQTIILNNILCQLQ

SEQ ID NO: 16934 - protein, 784 aa, Escherichia coli MS 198-1; identical to SEQ ID NO: 6283

SEQ ID NO: 16935 - protein, 119 aa, Escherichia coli MS 198-1; identical to SEQ ID NO: 5803

SEQ ID NO: 16936 - protein, 746 aa, Escherichia coli MS 198-1; identical to SEQ ID NO: 8052

SEQ ID NO: 16937 - protein, 224 aa, Escherichia coli MS 198-1; identical to SEQ ID NO: 14779

SEQ ID NO: 16938 - protein, 831 aa, Escherichia coli MS 198-1
MQELPMLRMTPLASAIVALLLGIEAYAAEETFDTHFMIGGMKDQQVANIRLDDNQPLPGQYDIDIYVNKQWRGKYEIIVKDNPQETCLSREIIKRLGINTDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNSNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTSWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVTTPRRQIYMSNSTTFDDQGFASNNTGLSGTVGNRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRTDGQPLTFGYEVNDIHGHNIGVVGQGSQLFIRTNEVPPSVNVAIDKQQGLSCTITFGKEIDESRNYICQ

SEQ ID NO: 16939 - protein, 222 aa, Escherichia coli MS 198-1; identical to SEQ ID NO: 14796

SEQ ID NO: 16940 - protein, 111 aa, Escherichia coli MS 198-1; identical to SEQ ID NO: 8631

SEQ ID NO: 16941 - protein, 362 aa, Escherichia coli MS 198-1; identical to SEQ ID NO: 5813

SEQ ID NO: 16942 - protein, 725 aa, Escherichia coli MS 200-1; identical to SEQ ID NO: 6241

SEQ ID NO: 16943 - protein, 883 aa, Escherichia coli MS 200-1
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTQGGNTSSGTSGYSSLNYRGAYGNTNVGYSRSGDSSQIYYGMSGGIIAHADGITFGQPLGDTIVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPAVSPGTLLNQQTAICR

SEQ ID NO: 16944 - protein, 224 aa, Escherichia coli MS 200-1
MATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTHLAMAPEEAPAMLRFRRSGSKFTLINPTPYFITVTNMKAGNSNLPNTMVPPKGEVSVDIPHAVTGDISFQTINDYGALTPRIKATMQ

SEQ ID NO: 16945 - protein, 421 aa, Escherichia coli MS 200-1; identical to SEQ ID NO: 14723

SEQ ID NO: 16946 - protein, 732 aa, Escherichia coli MS 200-1; identical to SEQ ID NO: 8819

SEQ ID NO: 16947 - protein, 654 aa, Escherichia coli MS 200-1; identical to SEQ ID NO: 8265

SEQ ID NO: 16948 - protein, 518 aa, Escherichia coli MS 200-1; identical to SEQ ID NO: 7565

SEQ ID NO: 16949 - protein, 231 aa, Escherichia coli MS 200-1; identical to SEQ ID NO: 6256

SEQ ID NO: 16950 - protein, 876 aa, Escherichia coli MS 200-1; identical to SEQ ID NO: 6255

SEQ ID NO: 16951 - protein, 1024 aa, Escherichia coli MS 200-1; identical to SEQ ID NO: 7555

SEQ ID NO: 16952 - protein, 628 aa, Escherichia coli MS 200-1; identical to SEQ ID NO: 8252

SEQ ID NO: 16953 - protein, 700 aa, Escherichia coli MS 200-1; identical to SEQ ID NO: 14710

SEQ ID NO: 16954 - protein, 541 aa, Escherichia coli MS 200-1; identical to SEQ ID NO: 15907

SEQ ID NO: 16955 - protein, 836 aa, Escherichia coli MS 200-1; identical to SEQ ID NO: 14670

SEQ ID NO: 16956 - protein, 244 aa, Escherichia coli MS 200-1; identical to SEQ ID NO: 14671

SEQ ID NO: 16957 - protein, 505 aa, Escherichia coli MS 200-1; identical to SEQ ID NO: 14677

SEQ ID NO: 16958 - protein, 432 aa, Escherichia coli MS 200-1; identical to SEQ ID NO: 5727

SEQ ID NO: 16959 - protein, 721 aa, Escherichia coli MS 200-1; identical to SEQ ID NO: 6807

SEQ ID NO: 16960 - protein, 175 aa, Escherichia coli MS 200-1
MLRFVLFFFTLSVSAVVQGSVVIMGTRVVYPATQKSISIRLNNDNESPALVQSWLDDGDAAAPPESVHVPFIITPPIFRMDSKSGQTVRIVYTGESLPKDRESLFYLNVLDIPAKPRAKKDSDNSEQRNNNYLQLAIRSRIKFFFRPAHLKLTPNDAYLKVTWHHAKWHLNRSQF

SEQ ID NO: 16961 - protein, 111 aa, Escherichia coli MS 200-1; identical to SEQ ID NO: 5889

SEQ ID NO: 16962 - protein, 103 aa, Escherichia coli MS 200-1; identical to SEQ ID NO: 14722

SEQ ID NO: 16963 - protein, 478 aa, Escherichia coli MS 200-1; identical to SEQ ID NO: 6796

SEQ ID NO: 16964 - protein, 446 aa, Escherichia coli MS 200-1; identical to SEQ ID NO: 14690

SEQ ID NO: 16965 - protein, 861 aa, Escherichia coli MS 200-1; identical to SEQ ID NO: 7583

SEQ ID NO: 16966 - protein, 192 aa, Escherichia coli MS 200-1
MKSKKYFIILLALAAIAGLGTHAAWSSNGLPRIDNKTLARLAQQHPVVVLFRHAERCDRSTNQCLSDKTGITVKGTQDARELGNAFSADIPDFNLYSSNTVRTIQSATWFSAGKKLTVDKRFLQCGNEIYSAIKDLQRKAPDKNIVIFTHNHCLTYIAKDKRDATFKPDYLDGLVMHVEKGKVYLDGEFVNH

SEQ ID NO: 16967 - protein, 367 aa, Escherichia coli MS 200-1; identical to SEQ ID NO: 5906

SEQ ID NO: 16968 - protein, 169 aa, Escherichia coli MS 200-1; identical to SEQ ID NO: 8240

SEQ ID NO: 16969 - protein, 728 aa, Escherichia coli MS 200-1
MIIVIVCIIVTPQSKKADKSEAVPAFWDDHLHTNKSTAMLPYARGRKEDVSDTHFIFVVTSWRYGMFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQERDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPELKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 16970 - protein, 224 aa, Escherichia coli MS 200-1; identical to SEQ ID NO: 5893

SEQ ID NO: 16971 - protein, 831 aa, Escherichia coli MS 200-1
MQELPMLRMTPLASAIVALLIGIEAYAAEETFDTHFMIGGMKDQQVSNIRLEDNQPLPGQYDIDIYVNKQWRGKYEIIVKDNPQETCLSREMIKRLGINTDNFASGKQCLTFKQLIQGGSYTWDIGVFRLDFSVPQAWVEELESGYVPPENWERGINAFYTSYYVSQYYSDYKASGNSKSTYVRFNSGLNLLGWQLHSDASFSKTNNNPGGWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGHQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICQ

SEQ ID NO: 16972 - protein, 122 aa, Escherichia coli MS 200-1; identical to SEQ ID NO: 5737

SEQ ID NO: 16973 - protein, 192 aa, Escherichia coli MS 200-1; identical to SEQ ID NO: 16439

SEQ ID NO: 16974 - protein, 213 aa, Escherichia coli MS 200-1; identical to SEQ ID NO: 5744

SEQ ID NO: 16975 - protein, 578 aa, Escherichia coli MS 200-1
MALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQNDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTFKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 16976 - protein, 191 aa, Escherichia coli MS 200-1; identical to SEQ ID NO: 14698

SEQ ID NO: 16977 - protein, 517 aa, Escherichia coli MS 200-1; identical to SEQ ID NO: 6817

SEQ ID NO: 16978 - protein, 362 aa, Escherichia coli MS 200-1; identical to SEQ ID NO: 5874

SEQ ID NO: 16979 - protein, 204 aa, Escherichia coli MS 200-1; identical to SEQ ID NO: 5755

SEQ ID NO: 16980 - protein, 784 aa, Escherichia coli MS 200-1; identical to SEQ ID NO: 8272

SEQ ID NO: 16981 - protein, 825 aa, Escherichia coli MS 200-1
MGKDASNIDLSRYTEGNPTLPGIYDVSVYVNDQPIMSQSIAFAVIEGKKNAQACITQKNLLQFHISSPDKNSEKAILLKRDEDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQELEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNTTSEKIAQSIILNGLRCQIQ

SEQ ID NO: 16982 - protein, 230 aa, Escherichia coli MS 200-1
MAFSSSAIADIVISGTRVVYKSEQKNVNVRLENKGNNPLLVQSWLDTGDDNAEPGSITVPFTATPPVSRIDAKRGQTIKLMYTASSALPKDRESVFWFNVLEVPPKPDAAKAANQSLLQLAFRTRIKLFYRPEGLSGISSDAPLALKWSWATSEGKAALRVDNPTPYYVSFSSGDLEANGKRYPLDMTMIAPFSNDVIKVNGMSGRTSSAKVHFFAINDFGGSIEGNANL

SEQ ID NO: 16983 - protein, 721 aa, Escherichia coli MS 200-1; identical to SEQ ID NO: 15966

SEQ ID NO: 16984 - protein, 266 aa, Escherichia coli MS 200-1; identical to SEQ ID NO: 7500

SEQ ID NO: 16985 - protein, 161 aa, Escherichia coli MS 200-1; identical to SEQ ID NO: 5769

SEQ ID NO: 16986 - protein, 719 aa, Escherichia coli MS 200-1; identical to SEQ ID NO: 8210

SEQ ID NO: 16987 - protein, 208 aa, Escherichia coli MS 200-1; identical to SEQ ID NO: 14719

SEQ ID NO: 16988 - protein, 614 aa, Escherichia coli MS 200-1
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDVWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGSYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 16989 - protein, 274 aa, Escherichia coli MS 200-1; identical to SEQ ID NO: 14653

SEQ ID NO: 16990 - protein, 242 aa, Escherichia coli MS 200-1
MLVSTALMALLTTASLTAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRKPWQFKVTLTRSGQDYTVNNPTPYHVIISDASTQKKGLTAAGFKPLVMPPKTSQPLKAKMASAPVLTYINDYGARMPLIFRCEGNTCKVDEDQSSKG

SEQ ID NO: 16991 - protein, 882 aa, Escherichia coli MS 200-1
MPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLEEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKHWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 16992 - protein, 386 aa, Escherichia coli MS 200-1; identical to SEQ ID NO: 8261

SEQ ID NO: 16993 - protein, 250 aa, Escherichia coli MS 200-1
MIKVVIVLFSLLFSTAQAGLVIGGTRFAYPENQSSISVELKNTSDRDMLVKVAVSPDDARQLTGTVESLPSYSETVFIATPPLFVLKPDKNTKIRINRVGGSLPADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDIYNNVLPAWKVNMNLLQMDVSGSQVKTD

SEQ ID NO: 16994 - protein, 250 aa, Escherichia coli MS 200-1; identical to SEQ ID NO: 14682

SEQ ID NO: 16995 - protein, 629 aa, Escherichia coli MS 200-1
MTVTATGNARSSFEAPMMVSVIDTSAPENQTATSATDLLRYVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 16996 - protein, 353 aa, Escherichia coli MS 200-1
MKMKKSTLALVVMGIVASVSVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLESDNKLNINNDDIVAVGMTYQF

SEQ ID NO: 16997 - protein, 760 aa, Escherichia coli MS 200-1; identical to SEQ ID NO: 14716

SEQ ID NO: 16998 - protein, 331 aa, Escherichia coli MS 200-1; identical to SEQ ID NO: 8190

SEQ ID NO: 16999 - protein, 431 aa, Escherichia coli MS 200-1; identical to SEQ ID NO: 6791

SEQ ID NO: 17000 - protein, 368 aa, Escherichia coli MS 200-1; identical to SEQ ID NO: 7561

SEQ ID NO: 17001 - protein, 241 aa, Escherichia coli MS 200-1; identical to SEQ ID NO: 6140

SEQ ID NO: 17002 - protein, 878 aa, Escherichia coli MS 200-1; identical to SEQ ID NO: 14664

SEQ ID NO: 17003 - protein, 681 aa, Escherichia coli MS 200-1; identical to SEQ ID NO: 16697

SEQ ID NO: 17004 - protein, 713 aa, Escherichia coli MS 200-1
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNIPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 17005 - protein, 222 aa, Escherichia coli MS 200-1; identical to SEQ ID NO: 5850

SEQ ID NO: 17006 - protein, 673 aa, Escherichia coli MS 200-1
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSINTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 17007 - protein, 275 aa, Escherichia coli MS 200-1
NRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGLVYQF

SEQ ID NO: 17008 - protein, 303 aa, Escherichia coli MS 200-1
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGG

SEQ ID NO: 17009 - protein, 229 aa, Escherichia coli MS 200-1; identical to SEQ ID NO: 16536

SEQ ID NO: 17010 - protein, 554 aa, Escherichia coli MS 200-1
MALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILSRASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 17011 - protein, 656 aa, Escherichia coli MS 200-1; identical to SEQ ID NO: 14673

SEQ ID NO: 17012 - protein, 771 aa, Escherichia coli MS 200-1; identical to SEQ ID NO: 14696

SEQ ID NO: 17013 - protein, 846 aa, Escherichia coli MS 200-1
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSNSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPGSCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIANGFQASKAYSANSIVDYNDAHYKTSVDQDAWGFVPGGDNPWKKYEPAKAWSASTVYVKGDRVVVDGQAYEALFWTQSDNPALVANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHAQLKGLYGNKSDAEIDAMMGTTPMVGVNDVQGEVFYLSDARLV

SEQ ID NO: 17014 - protein, 353 aa, Escherichia coli MS 21-1; identical to SEQ ID NO: 15872

SEQ ID NO: 17015 - protein, 663 aa, Escherichia coli MS 21-1; identical to SEQ ID NO: 8431

SEQ ID NO: 17016 - protein, 517 aa, Escherichia coli MS 21-1; identical to SEQ ID NO: 6817

SEQ ID NO: 17017 - protein, 518 aa, Escherichia coli MS 21-1
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQAYPAVSPTELGKEKFPFLSFLSQSSSNYLTHSPSLLFSRKGSEEKQN

SEQ ID NO: 17018 - protein, 567 aa, Escherichia coli MS 21-1
MKIKLRITIILISALCIFNGLLTPGAYAATANGYVANKENLRSFFETVSSYAGKPTIVSKLAMKKQISGNFDLTEPYALIERLSAQMGLIWYDDGKAIYIYDSSEMRNALINLRKVSVNEFNNFLKKSGLYNSRYEIKGGGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGVPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNVDDLPQVGRTLISTIARVPQGKSLLIGGYTRDTNTYESRKIPILGSIPFIGILFGYEGTNANNIVRVFLIEPREIDERMMNNANEAAVDARAITQQMAKNKEINDELLQKWIKTYLNREVVGG

SEQ ID NO: 17019 - protein, 432 aa, Escherichia coli MS 21-1; identical to SEQ ID NO: 5727

SEQ ID NO: 17020 - protein, 719 aa, Escherichia coli MS 21-1
MRNEMLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWRFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 17021 - protein, 224 aa, Escherichia coli MS 21-1; identical to SEQ ID NO: 8426

SEQ ID NO: 17022 - protein, 831 aa, Escherichia coli MS 21-1
MQELPMLRMPPLASAIVALLLGIEAYAAEETFDTHFMIGGMKDQQVANIRLDDNQPLPGQYDIDIYVNKQWRGKYEIIVKDNPQETCLSREIIKRLGINTDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNSNPGGWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICQ

SEQ ID NO: 17023 - protein, 169 aa, Escherichia coli MS 21-1; identical to SEQ ID NO: 8640

SEQ ID NO: 17024 - protein, 367 aa, Escherichia coli MS 21-1
MKVKVLSLLVPALLVAGAANAAEVYNKDGNKLDLYGKVDGLHYFSDNKSEDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGTNGSVSGEDQTNNGRGALRQNGDGVGGSITYDYEGFGVGAAVSSSKRTWDQNNTGLIGTGDRAETYTGGLKYDANNIYLAAQYTQTYNATRVGSLGWANKAQNFEAVAQYQFDFGLRPSVAYLQSKGKNLGTIGTRNYDDEDILKYVDVGATYYFNKNMSTYVDYKINLLDDNQFTRAAGINTDDIVALGLVYQF

SEQ ID NO: 17025 - protein, 219 aa, Escherichia coli MS 21-1
MSLNFTVIVWLRLSIGGVYVLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKNLQSKAPDKNIVIFTHNHCLTYIAKDKRDATFKPDYLDGLVMHVEKGKVYLDGEFVNH

SEQ ID NO: 17026 - protein, 274 aa, Escherichia coli MS 21-1; identical to SEQ ID NO: 5899

SEQ ID NO: 17027 - protein, 242 aa, Escherichia coli MS 21-1
MLVSTALAALLTTASLTAHASVTPDRTRLVFNESDKSISVTLRNNNEKLPYLAQSWLEDEKGNKITSPLAVLPPVQRIDAMMNGQVKIQALPDIHSLPSDRESLFYYNVREIPPKTGKANTLQIALQTRIKLFWRPKALEKIDMRKPWQFKVTLTRSGQDYTVNNPTPYHVIISDASTQKKGLTAAGFKPLVMPPKTSQPLKAKMASAPVLTYINDYGARMPLIFRCEGNTCKVDEDQSSKG

SEQ ID NO: 17028 - protein, 883 aa, Escherichia coli MS 21-1
MLNHSNFRLRGIACYIALAISGGSVNAWADDSIQFDPRFLELKGDTKIDLGKFSKKGYVDAGKYNLRVFINKQPLSDEYDINWYVSENDPTKTYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDEDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHRTEGGFFSGGEASWGVADGWSLYGGALADEHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQSMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMTVFWEGSAQCEIVLPKPLPADLFSGLLLPCEQKGTAAPDSSAPEIKPVIQDQTRQVTPTEAPTSISTTQ

SEQ ID NO: 17029 - protein, 208 aa, Escherichia coli MS 21-1; identical to SEQ ID NO: 5869

SEQ ID NO: 17030 - protein, 244 aa, Escherichia coli MS 21-1; identical to SEQ ID NO: 6219

SEQ ID NO: 17031 - protein, 836 aa, Escherichia coli MS 21-1
MKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKDAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 17032 - protein, 386 aa, Escherichia coli MS 21-1
MVDDVPVAQVLQALAEQEKLNLVVSPDVSGTVSLHLTDVPWKQALQTVVKSAGLITRQEGNILSVHSVAWQNDNIARQEAEQTRAQANLPLENRNITLQYADAGELAKAGEKLLSAKGSMTVDKRTNRLLLRDNKTALSTLEQWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 17033 - protein, 304 aa, Escherichia coli MS 21-1; identical to SEQ ID NO: 16044

SEQ ID NO: 17034 - protein, 222 aa, Escherichia coli MS 21-1; identical to SEQ ID NO: 7428

SEQ ID NO: 17035 - protein, 713 aa, Escherichia coli MS 21-1
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNADIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPSYFVADAFAAYKMKLQYPVTLQLNVKNLFDKTYYTSSIATNNLGNQIGDPREVQFTVKMEF

SEQ ID NO: 17036 - protein, 204 aa, Escherichia coli MS 21-1; identical to SEQ ID NO: 5755

SEQ ID NO: 17037 - protein, 236 aa, Escherichia coli MS 21-1
MTNTWNRLALLIFAVLSLLVASELQAGVVVGGTRFIFPADRDSISISLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAITPCHVAWRTINDYGGLSAKKEQNLP

SEQ ID NO: 17038 - protein, 404 aa, Escherichia coli MS 21-1
MYRTQRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACAPLAEIIPDASVTFNVNKLRLEISVPQIAIKSNARGYVPPERWDEGINALLLGYSFSGANSIHSSAGSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQVTIKQNGYTIYQTYVSPGAFEISDLYSTSSSGDLLVEIKEADGSVNSYSVPFSSVPLLQRQGRIKYAVTLAKYRTNSNDQQESKFAQATLQWGGAVGNDLVWRRAIC

SEQ ID NO: 17039 - protein, 233 aa, Escherichia coli MS 21-1; identical to SEQ ID NO: 8411

SEQ ID NO: 17040 - protein, 357 aa, Escherichia coli MS 21-1; identical to SEQ ID NO: 5807

SEQ ID NO: 17041 - protein, 431 aa, Escherichia coli MS 21-1; identical to SEQ ID NO: 6791

SEQ ID NO: 17042 - protein, 446 aa, Escherichia coli MS 21-1; identical to SEQ ID NO: 7485

SEQ ID NO: 17043 - protein, 478 aa, Escherichia coli MS 21-1
MTRIKINARRIFSLLIPFFFFTSVHAEQTAAPAKPVTVEAKNETFAPQHPDQYLSWKATSEQSGRVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 17044 - protein, 878 aa, Escherichia coli MS 21-1
MSYLNLRLYQRNTQCLHIRKHRLAGFFVRLFVACAFSAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQYINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 17045 - protein, 241 aa, Escherichia coli MS 21-1; identical to SEQ ID NO: 6143

SEQ ID NO: 17046 - protein, 368 aa, Escherichia coli MS 21-1
MNKTITALAIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAVDKINAYYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 17047 - protein, 891 aa, Escherichia coli MS 21-1
MILVDLLKATPTFNLARIYHSRKQNVTITSTKKYHNHLTRIATFCALLYSNSALCAELVEYDHTFLMGKDASNIDLSRYTEGNPTLPGIYDVSVYVNDQPIMSQSIAFTVIEGKKNAQACITQKNLLQFHISSSDKNSEKAILLKRDEDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQELEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAILNIVRSDGKNIPFAADIYDEQNNIIGNVGQGGQAFVRGIEQEGNIRITWIEEGKPVSCFAHYQQNTTSEKIAQSIILNGLRCQIQ

SEQ ID NO: 17048 - protein, 230 aa, Escherichia coli MS 21-1; identical to SEQ ID NO: 8200

SEQ ID NO: 17049 - protein, 752 aa, Escherichia coli MS 21-1; identical to SEQ ID NO: 7439

SEQ ID NO: 17050 - protein, 266 aa, Escherichia coli MS 21-1; identical to SEQ ID NO: 5772

SEQ ID NO: 17051 - protein, 161 aa, Escherichia coli MS 21-1; identical to SEQ ID NO: 5769

SEQ ID NO: 17052 - protein, 191 aa, Escherichia coli MS 21-1; identical to SEQ ID NO: 5748

SEQ ID NO: 17053 - protein, 235 aa, Escherichia coli MS 21-1
MIAMQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKSNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 17054 - protein, 686 aa, Escherichia coli MS 21-1
MIVEGSATAPDNGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMIRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYISSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 17055 - protein, 213 aa, Escherichia coli MS 21-1; identical to SEQ ID NO: 5744

SEQ ID NO: 17056 - protein, 122 aa, Escherichia coli MS 21-1
MEKNMKKRGAFLGLLLVSACASVFAANNETSKSVTFPKCEGLDAAGIAASVKRDYQQNRVARWADDQIIVGQADPVAWVSLQDIQGKDDKWSVPLTVRGKSADIHYQVSVDCKAGMAEYQRR

SEQ ID NO: 17057 - protein, 366 aa, Escherichia coli MS 21-1
MKLKIVAVVVTGLLAANVAHAAEVYNKDGNKLDLYGKVTALRYFTDDKRDDGDKTYARLGFKGETQINDQMIGFGHWEYDFKGYNDEANGSRGNKTRLAYAGLKISEFGSLDYGRNYGVGYDIGSWTDMLPEFGGDTWSQKDVFMTYRTTGVATYRNYDFFGLIEGLNFAAQYQGKNERTDNGHLYGADYTRANGDGFGISSTYVYDGFGIGAVYTKSDRTNAQERAAANPLNASGKNAELWATGIKYDANNIYFAANYAETLNMTTYGDGYISNKAQSFEVVTQYQFDFGLRPSLAYLKSKGRDLGRYGDQDMIEYIDVGATYFFNKNMSTYVDYKINLIDESDFTRAVDIRTDNIVATGITYQF

SEQ ID NO: 17058 - protein, 744 aa, Escherichia coli MS 21-1
MWSISCRYDYNFLNYLTYRAVSFSINLQFYYYDGVFPILNLAFFMKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVITQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGMNIAWRFE

SEQ ID NO: 17059 - protein, 541 aa, Escherichia coli MS 21-1; identical to SEQ ID NO: 6286

SEQ ID NO: 17060 - protein, 816 aa, Escherichia coli MS 21-1
MLRTTRWVAAIIFLYSFPGYAEETFDTHFMIGGMRGEKVSEYRFDNKQPLPGNYELDFYVNHQWRGKKDITIPESPAKPCLPKVLLTTLGVKTDNLNTEDNCILLDEAVHGGQYQWDISEHRLNLTVPQAYINELERGYVPPESWDRGIDVFYTSYNLSQYRSYDSNNNSNTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYTIYQKEVPPGPFTIADLQLSGSGSDLDVSIKEADGSVRSFLVPYSSVPNMLQPGVSNFDFIAGRSQIYGVKNQEDFLEANYIYGLNNLLTLYGGTILSDNYNAITLGNGWNTPLGAISFDATRSSSKLNNDTRHEGTSYQVAYNKYLLQTATHFSVAAWRYASQDYRTFSDHLYENDKINHQSDYDDFYDIGRKNSLSANIMQPLSNNLGNVSLSALWRNYWGRSGNAKDYQFSYSNSWQRISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPVATIDGSYSHSKNAWQSGGSISSGLVVWPGGINITNQLSDTFAILDAPGLEGAHINGQKYNRTNSKGQVVYDLMIPHRENHLVLDIANSESETELQGNRQIIAPYRGAVSYVQFTTDQRKPRYIQALRPDGSPLTFGYDVLDLQENNIGVVGQGSRLFIRVDEIPTGIKVALNDEQNLFCTITFQHVIDENKTYICQ

SEQ ID NO: 17061 - protein, 219 aa, Escherichia coli MS 21-1
MSFFILPVHAGVVIYGTRIIYPEKNREVLVQLMNQSKNASLIQAWIDDGNTTIAPEKIQVPFILTPPVSRVAGGSGQQLKIRKMPNNLPHNKESLFYLNVLDIPPNNPQNAGKNKIKLALQNRIKLLWRPSGIAPVDKKSFSQLNIKKKNNAISINNETANWITITTIKAQNVKVNNESILLPPFSNNDITLKNNHASEYELTVVDDYRNNIHSKIAAR

SEQ ID NO: 17062 - protein, 784 aa, Escherichia coli MS 21-1; identical to SEQ ID NO: 6283

SEQ ID NO: 17063 - protein, 265 aa, Escherichia coli MS 21-1; identical to SEQ ID NO: 5925

SEQ ID NO: 17064 - protein, 852 aa, Escherichia coli MS 21-1
MKTGVTGLALAVMVACVMFRAESGIARTYSFDAAMLKGGGKGVDLTLFEEGGQLPGIYPVDIILNGSRVDSQEMAFHAERDAEGRPYLKTCLTREMLARYGVRIEEYPALFRASGEGRGASVAEEACADLTAIPQATESYQFAAQQLVLGIPQVALRPQLRGIAPEALWDDGIPAFLLNWQADAGRSEYRGYGKRVTDSYWVSLQPGINIGPWRVRNLTTWNRSSGQSGKWESSYIRAERGLNGIKSRLTLGEDYTPSDIFDSVPFRGAMMSSDESMVPYNLREFAPVVRGIARTQARIEVRQNGYLIQSQTVAPGAFALTDLPVTGSGSDLQVTVLESDGTAQVFTVPFTTPAIALREGYLKYNVTAGQYRSSDDAVEHTSLGQVTAMYGLPWGLTVYGGLQGAEHYQSAALGLGWSLGRLGAVSLDTTHSRGQQKGHDYETGDTWRIRYNKSFELTGTSFTAASYQYSSDGYHTLPDVLDTWRDDRYAYRHTENRSRRTTLSLSQSLGQWGYVGLNGSRDEYRDRPHRDYFGASYSTSWNNISLSVNWSRNRNSGGYYGGWSRTEDSVSMWMSVPLGRWFGGTDNDISATAQMQRSTGQDTRYEAGLNGRAFDRRLYWDVREQMVPGSESHADTSRLNLTWYGTYGELTGMYSYSSTMRQLNAGMSGSMVAHSEGVTFGQRTGDTVALIAAPGVSGASVGGWPGVRTDFRGYTLAGYASPYQENVLTLDPTTFPEDAEVPQTDSRVVPTKGAVVRAGFRTRVGGRALVSLARQDGTPLPFGAVVTVEGEAGQAAGSAGVVGDRGEVYLSGLKESGKLKAQWGENSLCHADYRLPEEKGPAGIFLTRTVCM

SEQ ID NO: 17065 - protein, 229 aa, Escherichia coli MS 21-1
MANGNASIKGYNCNVSQGLVIIMPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTSDDAEKMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 17066 - protein, 554 aa, Escherichia coli MS 21-1
MALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSATGTGGGGGEYPLQDGFGWTNGVTLKMLDLICPKEQPCDNVPATRPLSESTTQPLKQKEAEPTP

SEQ ID NO: 17067 - protein, 656 aa, Escherichia coli MS 21-1
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEANLGYRQGWSRSQDNAYDMHASFAASSDLGYLQVSGSQLKQDFLGLPHGVNNDIAGKHGKMINSSADDKRGIVKLGFTPRENDEYTVTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 17068 - protein, 360 aa, Escherichia coli MS 21-1; identical to SEQ ID NO: 5879

SEQ ID NO: 17069 - protein, 746 aa, Escherichia coli MS 21-1
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 17070 - protein, 111 aa, Escherichia coli MS 21-1
MKKQIEGMTMKKVLALVVAAAMGLSSAAFAAETVTTPAPTATTTKAAPAKTTHHKKQHKAAPAQKAQAAKKHHKNAKAEQKAPEQKAQAAKKHAKKHSHQQPAKPAAQPAA

SEQ ID NO: 17071 - protein, 331 aa, Escherichia coli MS 21-1
MKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFTVSLTHPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 17072 - protein, 760 aa, Escherichia coli MS 21-1
MENNRNFPARQFHSLTFFAGLCIGITPVAQALAAEGQTNVDDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNIYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 17073 - protein, 629 aa, Escherichia coli MS 21-1; identical to SEQ ID NO: 16458

SEQ ID NO: 17074 - protein, 360 aa, Escherichia coli MS 21-1; identical to SEQ ID NO: 5891

SEQ ID NO: 17075 - protein, 637 aa, Escherichia coli MS 21-1
MKIPTTTDIPQRYTWCLAGICYSSLAILPSFLSYAESYFNPAFLLENGTSVADLSRFERGNHQPAGVYRVDLWRNDEFIGSQDIVFESTTVNTGDKSGGLMPCFNQALLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGKIAGWQALVGPYWKATT

SEQ ID NO: 17076 - protein, 256 aa, Escherichia coli MS 21-1
MCVRNQSNHFFILLIFAVRNTQGVLTMMTKIKLLMLIIFYLIISTSAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 17077 - protein, 415 aa, Escherichia coli MS 21-1
MHGAIISHVTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFIGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 17078 - protein, 243 aa, Escherichia coli MS 21-1; identical to SEQ ID NO: 7472

SEQ ID NO: 17079 - protein, 673 aa, Escherichia coli MS 21-1; identical to SEQ ID NO: 6170

SEQ ID NO: 17080 - protein, 879 aa, Escherichia coli MS 45-1
GADMFFGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVSLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRHDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTASCR

SEQ ID NO: 17081 - protein, 229 aa, Escherichia coli MS 45-1
MANGNASIKGYNCNVSQGLVIIMPLPDFRFIRLLPLATLVLTACSITTPKGPGKSPDSPQWRQHQQDVRNLNQYQTRGAFAYISDQQKVYARFFWQQTGQDRYRLLLTNPLGSTELELNAQPGNVQLVDNKGQRYTSDDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 17082 - protein, 554 aa, Escherichia coli MS 45-1
MALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIPTAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSATGTGGGGGEYPLQDGFGWTNGVTLKMLDLICPKEQPCDNVPATRPLSESTTQPVKQKEAEPTP

SEQ ID NO: 17083 - protein, 656 aa, Escherichia coli MS 45-1; identical to SEQ ID NO: 8223

SEQ ID NO: 17084 - protein, 249 aa, Escherichia coli MS 45-1; identical to SEQ ID NO: 5852

SEQ ID NO: 17085 - protein, 840 aa, Escherichia coli MS 45-1; identical to SEQ ID NO: 5851

SEQ ID NO: 17086 - protein, 222 aa, Escherichia coli MS 45-1; identical to SEQ ID NO: 5850

SEQ ID NO: 17087 - protein, 713 aa, Escherichia coli MS 45-1; identical to SEQ ID NO: 6056

SEQ ID NO: 17088 - protein, 681 aa, Escherichia coli MS 45-1; identical to SEQ ID NO: 16465

SEQ ID NO: 17089 - protein, 478 aa, Escherichia coli MS 45-1; identical to SEQ ID NO: 6796

SEQ ID NO: 17090 - protein, 517 aa, Escherichia coli MS 45-1; identical to SEQ ID NO: 6817

SEQ ID NO: 17091 - protein, 191 aa, Escherichia coli MS 45-1; identical to SEQ ID NO: 6818

SEQ ID NO: 17092 - protein, 235 aa, Escherichia coli MS 45-1; identical to SEQ ID NO: 8228

SEQ ID NO: 17093 - protein, 729 aa, Escherichia coli MS 45-1; identical to SEQ ID NO: 6821

SEQ ID NO: 17094 - protein, 213 aa, Escherichia coli MS 45-1; identical to SEQ ID NO: 16471

SEQ ID NO: 17095 - protein, 386 aa, Escherichia coli MS 45-1; identical to SEQ ID NO: 16461

SEQ ID NO: 17096 - protein, 673 aa, Escherichia coli MS 45-1; identical to SEQ ID NO: 6170

SEQ ID NO: 17097 - protein, 360 aa, Escherichia coli MS 45-1; identical to SEQ ID NO: 5879

SEQ ID NO: 17098 - protein, 614 aa, Escherichia coli MS 45-1; identical to SEQ ID NO: 5872

SEQ ID NO: 17099 - protein, 432 aa, Escherichia coli MS 45-1; identical to SEQ ID NO: 5727

SEQ ID NO: 17100 - protein, 541 aa, Escherichia coli MS 45-1; identical to SEQ ID NO: 15907

SEQ ID NO: 17101 - protein, 700 aa, Escherichia coli MS 45-1; identical to SEQ ID NO: 6848

SEQ ID NO: 17102 - protein, 208 aa, Escherichia coli MS 45-1; identical to SEQ ID NO: 5869

SEQ ID NO: 17103 - protein, 353 aa, Escherichia coli MS 45-1; identical to SEQ ID NO: 6846

SEQ ID NO: 17104 - protein, 241 aa, Escherichia coli MS 45-1; identical to SEQ ID NO: 8229

SEQ ID NO: 17105 - protein, 861 aa, Escherichia coli MS 45-1; identical to SEQ ID NO: 8230

SEQ ID NO: 17106 - protein, 368 aa, Escherichia coli MS 45-1; identical to SEQ ID NO: 8204

SEQ ID NO: 17107 - protein, 241 aa, Escherichia coli MS 45-1; identical to SEQ ID NO: 6139

SEQ ID NO: 17108 - protein, 878 aa, Escherichia coli MS 45-1; identical to SEQ ID NO: 6809

SEQ ID NO: 17109 - protein, 362 aa, Escherichia coli MS 45-1; identical to SEQ ID NO: 5874

SEQ ID NO: 17110 - protein, 204 aa, Escherichia coli MS 45-1; identical to SEQ ID NO: 5755

SEQ ID NO: 17111 - protein, 224 aa, Escherichia coli MS 45-1; identical to SEQ ID NO: 5893

SEQ ID NO: 17112 - protein, 831 aa, Escherichia coli MS 45-1; identical to SEQ ID NO: 6814

SEQ ID NO: 17113 - protein, 654 aa, Escherichia coli MS 45-1; identical to SEQ ID NO: 6816

SEQ ID NO: 17114 - protein, 900 aa, Escherichia coli MS 45-1; identical to SEQ ID NO: 6827

SEQ ID NO: 17115 - protein, 303 aa, Escherichia coli MS 45-1; identical to SEQ ID NO: 17008

SEQ ID NO: 17116 - protein, 784 aa, Escherichia coli MS 45-1; identical to SEQ ID NO: 6829

SEQ ID NO: 17117 - protein, 231 aa, Escherichia coli MS 45-1; identical to SEQ ID NO: 6154

SEQ ID NO: 17118 - protein, 1024 aa, Escherichia coli MS 45-1; identical to SEQ ID NO: 16735

SEQ ID NO: 17119 - protein, 774 aa, Escherichia coli MS 45-1
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLDQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYNDNNKGIYAGQPRTLYMQGSLKF

SEQ ID NO: 17120 - protein, 721 aa, Escherichia coli MS 45-1; identical to SEQ ID NO: 6807

SEQ ID NO: 17121 - protein, 518 aa, Escherichia coli MS 45-1; identical to SEQ ID NO: 8246

SEQ ID NO: 17122 - protein, 628 aa, Escherichia coli MS 45-1; identical to SEQ ID NO: 8252

SEQ ID NO: 17123 - protein, 725 aa, Escherichia coli MS 45-1; identical to SEQ ID NO: 6277

SEQ ID NO: 17124 - protein, 690 aa, Escherichia coli MS 45-1
MLPYARGRKEDVSDTHFIFVVTSWRYGMFRLNPFVRVGLCLSAISCAWPVLAVDDDGETMVVTASSVKKTLKDPPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 17125 - protein, 169 aa, Escherichia coli MS 45-1; identical to SEQ ID NO: 8240

SEQ ID NO: 17126 - protein, 375 aa, Escherichia coli MS 45-1; identical to SEQ ID NO: 5922

SEQ ID NO: 17127 - protein, 192 aa, Escherichia coli MS 45-1; identical to SEQ ID NO: 7823

SEQ ID NO: 17128 - protein, 274 aa, Escherichia coli MS 45-1; identical to SEQ ID NO: 5899

SEQ ID NO: 17129 - protein, 242 aa, Escherichia coli MS 45-1; identical to SEQ ID NO: 16450

SEQ ID NO: 17130 - protein, 882 aa, Escherichia coli MS 45-1; identical to SEQ ID NO: 8245

SEQ ID NO: 17131 - protein, 629 aa, Escherichia coli MS 45-1; identical to SEQ ID NO: 16458

SEQ ID NO: 17132 - protein, 250 aa, Escherichia coli MS 45-1; identical to SEQ ID NO: 5862

SEQ ID NO: 17133 - protein, 249 aa, Escherichia coli MS 45-1; identical to SEQ ID NO: 16460

SEQ ID NO: 17134 - protein, 111 aa, Escherichia coli MS 45-1; identical to SEQ ID NO: 5889

SEQ ID NO: 17135 - protein, 224 aa, Escherichia coli MS 45-1; identical to SEQ ID NO: 8215

SEQ ID NO: 17136 - protein, 883 aa, Escherichia coli MS 45-1; identical to SEQ ID NO: 6849

SEQ ID NO: 17137 - protein, 746 aa, Escherichia coli MS 45-1; identical to SEQ ID NO: 6783

SEQ ID NO: 17138 - protein, 696 aa, Escherichia coli MS 45-1; identical to SEQ ID NO: 6787

SEQ ID NO: 17139 - protein, 733 aa, Escherichia coli MS 45-1; identical to SEQ ID NO: 6152

SEQ ID NO: 17140 - protein, 719 aa, Escherichia coli MS 45-1; identical to SEQ ID NO: 8210

SEQ ID NO: 17141 - protein, 446 aa, Escherichia coli MS 45-1; identical to SEQ ID NO: 5873

SEQ ID NO: 17142 - protein, 431 aa, Escherichia coli MS 45-1; identical to SEQ ID NO: 6791

SEQ ID NO: 17143 - protein, 331 aa, Escherichia coli MS 45-1; identical to SEQ ID NO: 8190

SEQ ID NO: 17144 - protein, 760 aa, Escherichia coli MS 45-1; identical to SEQ ID NO: 6793

SEQ ID NO: 17145 - protein, 161 aa, Escherichia coli MS 45-1; identical to SEQ ID NO: 5769

SEQ ID NO: 17146 - protein, 266 aa, Escherichia coli MS 45-1; identical to SEQ ID NO: 6841

SEQ ID NO: 17147 - protein, 726 aa, Escherichia coli MS 45-1; identical to SEQ ID NO: 16426

SEQ ID NO: 17148 - protein, 230 aa, Escherichia coli MS 45-1; identical to SEQ ID NO: 8200

SEQ ID NO: 17149 - protein, 825 aa, Escherichia coli MS 45-1; identical to SEQ ID NO: 8201

SEQ ID NO: 17150 - protein, 347 aa, Escherichia coli MS 45-1
SVLMAMSAQAAEIYNKDSNKLDLYGKVNAKHYFSSNDADDGDTTYVRLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNDQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGLVYQF

SEQ ID NO: 17151 - protein, 122 aa, Escherichia coli MS 45-1; identical to SEQ ID NO: 5737

SEQ ID NO: 17152 - protein, 353 aa, Escherichia coli MS 57-2; identical to SEQ ID NO: 6846

SEQ ID NO: 17153 - protein, 700 aa, Escherichia coli MS 57-2
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRLTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYIPEDGWYAGTEARYMGDIMADDENTAKAPSYTLVGLFTGYKYNYHNFTVDLFGRVDNLFDKEYVGSVIVNESNGRYYEPAPGRNYGVGINIAWRFE

SEQ ID NO: 17154 - protein, 541 aa, Escherichia coli MS 57-2; identical to SEQ ID NO: 15907

SEQ ID NO: 17155 - protein, 362 aa, Escherichia coli MS 57-2; identical to SEQ ID NO: 5874

SEQ ID NO: 17156 - protein, 204 aa, Escherichia coli MS 57-2; identical to SEQ ID NO: 5755

SEQ ID NO: 17157 - protein, 760 aa, Escherichia coli MS 57-2
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDLSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPDEPRTFLLTANMHF

SEQ ID NO: 17158 - protein, 331 aa, Escherichia coli MS 57-2; identical to SEQ ID NO: 6551

SEQ ID NO: 17159 - protein, 431 aa, Escherichia coli MS 57-2; identical to SEQ ID NO: 6791

SEQ ID NO: 17160 - protein, 478 aa, Escherichia coli MS 57-2; identical to SEQ ID NO: 6796

SEQ ID NO: 17161 - protein, 386 aa, Escherichia coli MS 57-2; identical to SEQ ID NO: 8261

SEQ ID NO: 17162 - protein, 249 aa, Escherichia coli MS 57-2
MIKVVIVLFSLLFSTAQAGLVIGGTRFAYPENQSSISVELKNTSDRDMLVKIAVSPDDARQLTGTVESLPSYSETVFIATPPLFVLKPDKNTKIRINRVGGSLPADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDIYNNVLPILKVKLNPSQLDFTGFAFSQ

SEQ ID NO: 17163 - protein, 250 aa, Escherichia coli MS 57-2; identical to SEQ ID NO: 5862

SEQ ID NO: 17164 - protein, 629 aa, Escherichia coli MS 57-2
MTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKVYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 17165 - protein, 274 aa, Escherichia coli MS 57-2; identical to SEQ ID NO: 14653

SEQ ID NO: 17166 - protein, 242 aa, Escherichia coli MS 57-2
MLVSTALMALLTTASLTAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRRPWQFKVTLTRSGQDYTVNNPTPYHVIISDASTQKKGLTAAGFKPLVMPPKTSQPLKAKLASAPVLTYINDYGARMPLIFRCEGNTCKVDEDQSSKG

SEQ ID NO: 17167 - protein, 882 aa, Escherichia coli MS 57-2
MPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNADEHMMVFWEGSAQCEIVLPKPLPADLFSGLLLPCEQKGTAAPDSSAPEIKPVIQDQTRQVTPTEAPTSISATQ

SEQ ID NO: 17168 - protein, 654 aa, Escherichia coli MS 57-2; identical to SEQ ID NO: 8265

SEQ ID NO: 17169 - protein, 673 aa, Escherichia coli MS 57-2
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDAHTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 17170 - protein, 192 aa, Escherichia coli MS 57-2; identical to SEQ ID NO: 16439

SEQ ID NO: 17171 - protein, 518 aa, Escherichia coli MS 57-2; identical to SEQ ID NO: 8246

SEQ ID NO: 17172 - protein, 784 aa, Escherichia coli MS 57-2
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYKDEHPNDDSSRRWLFYWKHSGVMDQVWRFNVDYTKVSDPSYFNDFDNKYGSSTDGYATQKFSIGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTRLAESANRVMPQFKVDGRMVFERDMEMLAPGYTQTLEPRAQYLYVPYRDQSKIYNYDSSLLQSDYSGLFRDRTYGGLDRIASANQVTTGVTSRIYDDAAVERFNISVGQIYYFTESRTGDDNITWENDDKTGSLVWAGDTYWRISDRWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 17173 - protein, 825 aa, Escherichia coli MS 57-2
MGKDASNIDLSRYTEGNPTLPGIYDVSVYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQELEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNTTSEKIAQSIILNGLRCQIQ

SEQ ID NO: 17174 - protein, 230 aa, Escherichia coli MS 57-2; identical to SEQ ID NO: 8200

SEQ ID NO: 17175 - protein, 726 aa, Escherichia coli MS 57-2
MSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKMQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMIGYSFDHEFNDTFTVRQNLRFAQNKVSQKSVYGYGMCSDPLYTKDQEALKASPCLSIPQSQWGHTLTRQYVIDNEKLENFSVDTQLQSKFATGSVDHTLLTGVDFMRMRNDIDSWFGYAGSVAPSDIYNLDRSDFDFGAHPNPSGPYRVLLKQKQTGLYVQDQAQWDKVLVTLGGRYDWADQSSFNRDYGNKSERDDKEFTWRGGVNYLFDNGVTPYFSYSESFEPASQTDANGDLFAPSKGKQYEVGVKYVPEDRPIVVTGALYQLTKTNNLMADPNGSLFSVEGGEIRARGVELEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 17176 - protein, 266 aa, Escherichia coli MS 57-2; identical to SEQ ID NO: 5772

SEQ ID NO: 17177 - protein, 161 aa, Escherichia coli MS 57-2; identical to SEQ ID NO: 5769

SEQ ID NO: 17178 - protein, 517 aa, Escherichia coli MS 57-2
MKHKLQMMKTRWLSAAVMLTLYTSSSWAFSIDDVAKQAQSLAGKGYEAPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 17179 - protein, 191 aa, Escherichia coli MS 57-2; identical to SEQ ID NO: 14698

SEQ ID NO: 17180 - protein, 235 aa, Escherichia coli MS 57-2; identical to SEQ ID NO: 6404

SEQ ID NO: 17181 - protein, 729 aa, Escherichia coli MS 57-2; identical to SEQ ID NO: 6821

SEQ ID NO: 17182 - protein, 213 aa, Escherichia coli MS 57-2; identical to SEQ ID NO: 5744

SEQ ID NO: 17183 - protein, 446 aa, Escherichia coli MS 57-2; identical to SEQ ID NO: 5873

SEQ ID NO: 17184 - protein, 228 aa, Escherichia coli MS 57-2; identical to SEQ ID NO: 5866

SEQ ID NO: 17185 - protein, 843 aa, Escherichia coli MS 57-2
MHWMHLPLDHYRAHFSFSLLALTIASALPAYGGKFNPKFLENVQGIDQHVDLSVYDSPVGQQIPGKYRVFVFVNEEKMASRTLDFSTASEAQRKASGESLMPCLSRVQLEEMGVRIDSFPALKILPPEACVAFDEIIPQATSRFDFNTQTLHLTFPQAAMMMTARGTVDPSRWDEGIPALLLDYSFSGSNGRNEGSGSSPDSTSDSYYLNLRSGLNVGPWRLRNNSIWNRTDGKNQWDNVGTSLNRAIIPLKSQITLGDTATPGEIFDSVQMRGTLLASDDEMLPDSQRGFAPVVRGIAKSNAEVSIEQNGYVIYRTFVQPGAFEINDLYATSGSGDLTVIIKESDGSEQRFIQPFSAVAIFQREGYLKYSLAAGEYRAGNYDSGKPRFGQFTAMYGLPWGMTAYGGALLSADYNALALGLGKNFGTIGAVSVDVTQAKSQLRNNEKDEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSIAYTWTRSPEWDEDDRLWSFSLSIPLGGAWGSYRMTTDQNGKTSQQASVSGTLLEDRNLNYNVQQGYTSNGVGNSGSVNMGYMGGSGNIDVGYNYSKDNQQVNYGVRGGVIVHSEGITLSQPLGESLAIVSAPGAHGGHVVNSSGVEVDWMGNAVVPYLTPYRETIVELRSDTLGQNVELQEAFQKVVPTRGAIVRSRFDTRVGYRVLMSLKRANGNAVPFGATAALSDESKPASSIVGEEGQLYISGMPEEGELQVSWGHEQAQRCRVPFRLPEKKDNSGIVMVNAVCDK

SEQ ID NO: 17186 - protein, 122 aa, Escherichia coli MS 57-2; identical to SEQ ID NO: 5737

SEQ ID NO: 17187 - protein, 111 aa, Escherichia coli MS 57-2; identical to SEQ ID NO: 5889

SEQ ID NO: 17188 - protein, 224 aa, Escherichia coli MS 57-2; identical to SEQ ID NO: 8215

SEQ ID NO: 17189 - protein, 883 aa, Escherichia coli MS 57-2
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSAEKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTHGSNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNVQIGGKVLMTLKYGNKSVPFGAIVTHGENKNGSIVAENGQVYLTGLPQSGKLQVSWGNDKNSNCIVEYKLPEVSPGTLLNQQTAICR

SEQ ID NO: 17190 - protein, 208 aa, Escherichia coli MS 57-2; identical to SEQ ID NO: 5869

SEQ ID NO: 17191 - protein, 614 aa, Escherichia coli MS 57-2; identical to SEQ ID NO: 5872

SEQ ID NO: 17192 - protein, 192 aa, Escherichia coli MS 57-2; identical to SEQ ID NO: 7823

SEQ ID NO: 17193 - protein, 367 aa, Escherichia coli MS 57-2
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 17194 - protein, 169 aa, Escherichia coli MS 57-2; identical to SEQ ID NO: 8240

SEQ ID NO: 17195 - protein, 728 aa, Escherichia coli MS 57-2; identical to SEQ ID NO: 8238

SEQ ID NO: 17196 - protein, 224 aa, Escherichia coli MS 57-2
MKGLLALLISSMVLPAHAGIVIYGTRIIYPAEHKEVMVQLMNQGNRSSLMQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNASANWVTISDVKANNVKVNYETIMIAPLESQSVNVKSNNANNWHLTIIDDHGNYISDKI

SEQ ID NO: 17197 - protein, 831 aa, Escherichia coli MS 57-2
MQELPMLRMTPLASAIVALLIGIEAYAAEETFDTHFMIGGMKDQQVVNIRLEDNQPLPGQYDIDIYVNKQWRGKYEIIVKDNPQETCLSREMIKRLGINTDNFASGKQCLTFKQLIQGGSYTWDIGVFRLDFSVPQAWVEELESGYVPPENWERGINAFYTSYYVSQYYSDYKASGNSKSTYVRFNSGLNLQEWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGHQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRHDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICQ

SEQ ID NO: 17198 - protein, 746 aa, Escherichia coli MS 57-2; identical to SEQ ID NO: 6783

SEQ ID NO: 17199 - protein, 656 aa, Escherichia coli MS 57-2; identical to SEQ ID NO: 7573

SEQ ID NO: 17200 - protein, 846 aa, Escherichia coli MS 57-2
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSTSNTPASNTPANGGSATPAQGTVPSNSSVVAWNKQQGGQTWYVVFNGAVYKNAWWVASSNCPGDAKGNDASNPWRYVRAATAMEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPGSCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSANSIVDYNDAHYKTSVDQDAWGFVPGGDNPWKKYEPAKAWSASTVYVKGDRVVVDGQAYEALFWTQSDNPALVANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDALMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHAQLKGLYGNKSDAEIDAMMGTTPMVGVNDVQGEVFYLSDARLV

SEQ ID NO: 17201 - protein, 229 aa, Escherichia coli MS 57-2; identical to SEQ ID NO: 16536

SEQ ID NO: 17202 - protein, 554 aa, Escherichia coli MS 57-2; identical to SEQ ID NO: 17010

SEQ ID NO: 17203 - protein, 656 aa, Escherichia coli MS 57-2
MRLKKRYLCTVLSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEANLGYRQGWSRSHDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 17204 - protein, 275 aa, Escherichia coli MS 57-2; identical to SEQ ID NO: 17007

SEQ ID NO: 17205 - protein, 432 aa, Escherichia coli MS 57-2; identical to SEQ ID NO: 5727

SEQ ID NO: 17206 - protein, 305 aa, Escherichia coli MS 57-2
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAG

SEQ ID NO: 17207 - protein, 681 aa, Escherichia coli MS 57-2; identical to SEQ ID NO: 16697

SEQ ID NO: 17208 - protein, 713 aa, Escherichia coli MS 57-2; identical to SEQ ID NO: 11059

SEQ ID NO: 17209 - protein, 222 aa, Escherichia coli MS 57-2; identical to SEQ ID NO: 5850

SEQ ID NO: 17210 - protein, 840 aa, Escherichia coli MS 57-2
MNNKNTFSRDKLSHAIKNALSGVVCSLLFVLPVHAVEFNVDMIDAEDRENIDISRFEKKGYIPPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDTGIAGFILDYNVYASQYAPHHGDSTQNVSSYGTLGFNLGAWRLRSDYQYNQNFADGRSVNRDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSGNLRGYSYRFNYAKHFESTGSQITFAGYRFSDKDYVSMSEYLSSRNGDESIDNEKESYVISLNQYFETLELNSYLNVTRNTYWDSTSNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGIEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSTLHLTWGDNTCEVTPPNQSNISESAIILPCKTVK

SEQ ID NO: 17211 - protein, 237 aa, Escherichia coli MS 57-2
MICLLGICNFAQATVSPDRTRIIFNASNKSATVRLTNQSKIDPYLAQSWIEDASGKKTRDYISTLPPMERIEPDEQIQIRLMALASLNDLPQDRETLFYYNVREIPPRAKEQNVMQIAMQSRLKLFWRPKAIELKEGEMIPLQKVTITRTAAGLTLNNPTPYHITVGYIGTNGKTLMPGADSIMVAPFTSATQHLSSLPSTFQLGFVADYGGLEMFKVECNSIQSLCQSSPAKKGKI

SEQ ID NO: 17212 - protein, 753 aa, Escherichia coli MS 57-2; identical to SEQ ID NO: 5801

SEQ ID NO: 17213 - protein, 368 aa, Escherichia coli MS 57-2
MNKTITALAILMASFAANASVLPETPVPFKSGTGAIDNDTVYIGLGSAGTAWYKLDTQAKNKSWTALAAFPGGPRDQATSAFIDGNLYVFGGIGKNSEGLTQVFNDVHKYNPKTNSWIKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGDNLKWNKLAPVASPDGVAGGFAGMSNDSLIFAGGAGFKGSRENYQNGKNYAHEGLKKSYSADIHLWHNGKWDKSGELSQGRAYGVSLPWNNSLLIIGGETAGGKAVMDSVLLSVRDNKVTVQN

SEQ ID NO: 17214 - protein, 241 aa, Escherichia coli MS 57-2; identical to SEQ ID NO: 6136

SEQ ID NO: 17215 - protein, 861 aa, Escherichia coli MS 57-2
FFFFFFFFFFLFFFFPVSPPPRPPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 17216 - protein, 119 aa, Escherichia coli MS 57-2; identical to SEQ ID NO: 5803

SEQ ID NO: 17217 - protein, 229 aa, Escherichia coli MS 60-1; identical to SEQ ID NO: 16536

SEQ ID NO: 17218 - protein, 554 aa, Escherichia coli MS 60-1; identical to SEQ ID NO: 17010

SEQ ID NO: 17219 - protein, 656 aa, Escherichia coli MS 60-1; identical to SEQ ID NO: 14673

SEQ ID NO: 17220 - protein, 478 aa, Escherichia coli MS 60-1; identical to SEQ ID NO: 6796

SEQ ID NO: 17221 - protein, 353 aa, Escherichia coli MS 60-1; identical to SEQ ID NO: 16996

SEQ ID NO: 17222 - protein, 432 aa, Escherichia coli MS 60-1; identical to SEQ ID NO: 5727

SEQ ID NO: 17223 - protein, 505 aa, Escherichia coli MS 60-1; identical to SEQ ID NO: 14677

SEQ ID NO: 17224 - protein, 753 aa, Escherichia coli MS 60-1; identical to SEQ ID NO: 5801

SEQ ID NO: 17225 - protein, 781 aa, Escherichia coli MS 60-1
MAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQPTRSNDDDDDSSNSTTSKHWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGGGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 17226 - protein, 242 aa, Escherichia coli MS 60-1; identical to SEQ ID NO: 16990

SEQ ID NO: 17227 - protein, 274 aa, Escherichia coli MS 60-1; identical to SEQ ID NO: 14653

SEQ ID NO: 17228 - protein, 541 aa, Escherichia coli MS 60-1; identical to SEQ ID NO: 15907

SEQ ID NO: 17229 - protein, 700 aa, Escherichia coli MS 60-1; identical to SEQ ID NO: 14710

SEQ ID NO: 17230 - protein, 721 aa, Escherichia coli MS 60-1; identical to SEQ ID NO: 6807

SEQ ID NO: 17231 - protein, 654 aa, Escherichia coli MS 60-1; identical to SEQ ID NO: 8265

SEQ ID NO: 17232 - protein, 900 aa, Escherichia coli MS 60-1; identical to SEQ ID NO: 5859

SEQ ID NO: 17233 - protein, 260 aa, Escherichia coli MS 60-1; identical to SEQ ID NO: 6790

SEQ ID NO: 17234 - protein, 103 aa, Escherichia coli MS 60-1; identical to SEQ ID NO: 14722

SEQ ID NO: 17235 - protein, 111 aa, Escherichia coli MS 60-1; identical to SEQ ID NO: 5889

SEQ ID NO: 17236 - protein, 386 aa, Escherichia coli MS 60-1; identical to SEQ ID NO: 8261

SEQ ID NO: 17237 - protein, 250 aa, Escherichia coli MS 60-1; identical to SEQ ID NO: 16993

SEQ ID NO: 17238 - protein, 250 aa, Escherichia coli MS 60-1; identical to SEQ ID NO: 14682

SEQ ID NO: 17239 - protein, 629 aa, Escherichia coli MS 60-1; identical to SEQ ID NO: 16995

SEQ ID NO: 17240 - protein, 861 aa, Escherichia coli MS 60-1; identical to SEQ ID NO: 7583

SEQ ID NO: 17241 - protein, 241 aa, Escherichia coli MS 60-1; identical to SEQ ID NO: 7582

SEQ ID NO: 17242 - protein, 446 aa, Escherichia coli MS 60-1; identical to SEQ ID NO: 14690

SEQ ID NO: 17243 - protein, 244 aa, Escherichia coli MS 60-1; identical to SEQ ID NO: 14671

SEQ ID NO: 17244 - protein, 836 aa, Escherichia coli MS 60-1; identical to SEQ ID NO: 14670

SEQ ID NO: 17245 - protein, 883 aa, Escherichia coli MS 60-1; identical to SEQ ID NO: 16943

SEQ ID NO: 17246 - protein, 224 aa, Escherichia coli MS 60-1; identical to SEQ ID NO: 16944

SEQ ID NO: 17247 - protein, 161 aa, Escherichia coli MS 60-1; identical to SEQ ID NO: 5769

SEQ ID NO: 17248 - protein, 367 aa, Escherichia coli MS 60-1; identical to SEQ ID NO: 5906

SEQ ID NO: 17249 - protein, 169 aa, Escherichia coli MS 60-1; identical to SEQ ID NO: 8240

SEQ ID NO: 17250 - protein, 728 aa, Escherichia coli MS 60-1; identical to SEQ ID NO: 16969

SEQ ID NO: 17251 - protein, 224 aa, Escherichia coli MS 60-1; identical to SEQ ID NO: 5893

SEQ ID NO: 17252 - protein, 831 aa, Escherichia coli MS 60-1; identical to SEQ ID NO: 16971

SEQ ID NO: 17253 - protein, 725 aa, Escherichia coli MS 60-1; identical to SEQ ID NO: 6241

SEQ ID NO: 17254 - protein, 518 aa, Escherichia coli MS 60-1; identical to SEQ ID NO: 7565

SEQ ID NO: 17255 - protein, 360 aa, Escherichia coli MS 60-1; identical to SEQ ID NO: 5891

SEQ ID NO: 17256 - protein, 673 aa, Escherichia coli MS 60-1; identical to SEQ ID NO: 6170

SEQ ID NO: 17257 - protein, 517 aa, Escherichia coli MS 60-1; identical to SEQ ID NO: 6817

SEQ ID NO: 17258 - protein, 191 aa, Escherichia coli MS 60-1; identical to SEQ ID NO: 14698

SEQ ID NO: 17259 - protein, 578 aa, Escherichia coli MS 60-1; identical to SEQ ID NO: 16975

SEQ ID NO: 17260 - protein, 213 aa, Escherichia coli MS 60-1; identical to SEQ ID NO: 5744

SEQ ID NO: 17261 - protein, 192 aa, Escherichia coli MS 60-1; identical to SEQ ID NO: 16439

SEQ ID NO: 17262 - protein, 192 aa, Escherichia coli MS 60-1; identical to SEQ ID NO: 16966

SEQ ID NO: 17263 - protein, 760 aa, Escherichia coli MS 60-1; identical to SEQ ID NO: 14716

SEQ ID NO: 17264 - protein, 204 aa, Escherichia coli MS 60-1; identical to SEQ ID NO: 5755

SEQ ID NO: 17265 - protein, 362 aa, Escherichia coli MS 60-1; identical to SEQ ID NO: 5874

SEQ ID NO: 17266 - protein, 368 aa, Escherichia coli MS 60-1; identical to SEQ ID NO: 7561

SEQ ID NO: 17267 - protein, 878 aa, Escherichia coli MS 60-1; identical to SEQ ID NO: 14664

SEQ ID NO: 17268 - protein, 241 aa, Escherichia coli MS 60-1
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALSPDQAAEKLRFRRSANSLTLINPTPYYLTVTELNAGTRVLENALVPPMGESAVKLPSDAGSNITYRTINDYGALTPKMTGVME

SEQ ID NO: 17269 - protein, 122 aa, Escherichia coli MS 60-1; identical to SEQ ID NO: 5737

SEQ ID NO: 17270 - protein, 208 aa, Escherichia coli MS 60-1; identical to SEQ ID NO: 14719

SEQ ID NO: 17271 - protein, 614 aa, Escherichia coli MS 60-1; identical to SEQ ID NO: 14702

SEQ ID NO: 17272 - protein, 784 aa, Escherichia coli MS 60-1; identical to SEQ ID NO: 8272

SEQ ID NO: 17273 - protein, 825 aa, Escherichia coli MS 60-1; identical to SEQ ID NO: 16981

SEQ ID NO: 17274 - protein, 230 aa, Escherichia coli MS 60-1; identical to SEQ ID NO: 16982

SEQ ID NO: 17275 - protein, 721 aa, Escherichia coli MS 60-1; identical to SEQ ID NO: 15966

SEQ ID NO: 17276 - protein, 266 aa, Escherichia coli MS 60-1; identical to SEQ ID NO: 7500

SEQ ID NO: 17277 - protein, 222 aa, Escherichia coli MS 60-1; identical to SEQ ID NO: 5850

SEQ ID NO: 17278 - protein, 713 aa, Escherichia coli MS 60-1; identical to SEQ ID NO: 17004

SEQ ID NO: 17279 - protein, 681 aa, Escherichia coli MS 60-1; identical to SEQ ID NO: 16697

SEQ ID NO: 17280 - protein, 360 aa, Escherichia coli MS 60-1
MMKKYLALALIAPLLISCSTTKKGDTYNEAWVKDTNGFDILMGQFAHNIENIWGFKKVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 17281 - protein, 856 aa, Escherichia coli MS 60-1; identical to SEQ ID NO: 6166

SEQ ID NO: 17282 - protein, 267 aa, Escherichia coli MS 60-1; identical to SEQ ID NO: 15862

SEQ ID NO: 17283 - protein, 331 aa, Escherichia coli MS 60-1; identical to SEQ ID NO: 8190

SEQ ID NO: 17284 - protein, 1024 aa, Escherichia coli MS 60-1; identical to SEQ ID NO: 7555

SEQ ID NO: 17285 - protein, 231 aa, Escherichia coli MS 60-1; identical to SEQ ID NO: 6256

SEQ ID NO: 17286 - protein, 876 aa, Escherichia coli MS 60-1; identical to SEQ ID NO: 6255

SEQ ID NO: 17287 - protein, 771 aa, Escherichia coli MS 60-1; identical to SEQ ID NO: 14696

SEQ ID NO: 17288 - protein, 431 aa, Escherichia coli MS 60-1; identical to SEQ ID NO: 6791

SEQ ID NO: 17289 - protein, 119 aa, Escherichia coli MS 60-1; identical to SEQ ID NO: 5803

SEQ ID NO: 17290 - protein, 719 aa, Escherichia coli MS 60-1; identical to SEQ ID NO: 8210

SEQ ID NO: 17291 - protein, 656 aa, Escherichia coli MS 69-1
MRLKKRYLCTALSLAFTQQAVAAQESDTLTVWSSPVSSTTTTVLDQPTMKALDKQNVAQALSVVPGVVLQKSGSRNEEQVKIRGFDSRQVPVYFDGVPIYVPYDGNLDLARILTNNLGAVEVSKGYSSLLQGPNQMGGAINITTQKPTKPLEANLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKERFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLNVTLSEEARSSSYSNSDGSQKAAGFAVTHIRADYTLGHGFSVNASVNNLFDTQYAYSEGFIEEGRNFWAGIEYTF

SEQ ID NO: 17292 - protein, 207 aa, Escherichia coli MS 69-1; identical to SEQ ID NO: 5743

SEQ ID NO: 17293 - protein, 713 aa, Escherichia coli MS 69-1
MAKFTPSFSGIKGRALFSLLFAAPMIHATDTATTKDGETITVTADANTATEATDGYQPLSTSMATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYGDNQARVTAYDATTGTLTRRVDATQGSTQRMHATRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 17294 - protein, 541 aa, Escherichia coli MS 69-1; identical to SEQ ID NO: 6286

SEQ ID NO: 17295 - protein, 1024 aa, Escherichia coli MS 69-1
MPTITTAQIKSTLQSAKQSSANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKRQKSGSNVSSSELAKASIELINQLVDTAASINNNVNSFSQQLNKLGSVLSNTKHLNGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKILQEVVKEQEVSVGKRTEKTQYRSYEFTHINGKNLTETDNLYSVEELIGTTRADKFFGSKFTDIFHGADGDDHIEGNDGNDRLYGDKGNDTLRGGNGDDQLYGGDGNDKLIGGTGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFRREDNDLIMYKAEGNVLSIGHKNGITFRNWFEKESGDISNHQIEQIFDKDGRVITPDSLKKALEYQQSNNKASYVYGNDALAYGSQDNLNPLINEISKIISAAGNFDVKEERAAASLLQLSGNASDFSYGRNSITLTASA

SEQ ID NO: 17296 - protein, 719 aa, Escherichia coli MS 69-1
MRDEMLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEIVKGPYSVLYGSQAIGGIVNFITKKGGNKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVNQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 17297 - protein, 673 aa, Escherichia coli MS 69-1; identical to SEQ ID NO: 8416

SEQ ID NO: 17298 - protein, 250 aa, Escherichia coli MS 69-1
MRWISKNKCFSNRNINSLLKTQYIIRAGALFLLSAISINAIAAGGFGLGSTRLVYPSDSQQITLSVQNGGANTSYLIQSWIDDNQSSKKSQDFVVTPPLFMLPTRKEASLRIMFIGKSQLPTDRETLFWMNVKAIPPTDEKNTQKNTLQLALQNRIKLFYRPTNLPVQAGKARDMLRFKYEGKQLRVINPSPYYLTVTGIRVQGAKLPNAFVPPKSDVTVSSPVMLAGEITYQTINDYGATTARQKGTMQ

SEQ ID NO: 17299 - protein, 239 aa, Escherichia coli MS 69-1
MHQMQTTRTLYSISFMATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 17300 - protein, 883 aa, Escherichia coli MS 69-1
MTAFHAAFKAYRMHQVLILPRFVRLTFALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHLAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSATSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 17301 - protein, 732 aa, Escherichia coli MS 69-1
MMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 17302 - protein, 369 aa, Escherichia coli MS 69-1
MKVKNFIYLPFCLFIGTSVAGALPEIPEPFKYGVGGIENGKIYIGLGSLGNNWYMIDTNQSEKKWTKIAQWPTVPREQATATIIDGKIYVFGGIGKDTSGVITLQKDVYSYDIAKDKWEKLMTRPPVSLAGHVSFIHNGHAVSTGGVNENIFNGYFSDVELSKGNSALTEKVNRDYFSKPADDYFLNNHIISYDPSKNQWKNLGTTPFPGTAGSSVIFAEQQIYILGGERKPGLRSVRSWTGELSHDRIKWSELPPVASPEGVSGAYASVIDGNIFLAGGAYFPGAAEKYSNGEYWSHKGLDKAYSKEIYQLIKNDWKKVGSLPEGLAYGVSLPWQGGMLILGGEKKDGKAVSDVIYLKKNDKQIKIVK

SEQ ID NO: 17303 - protein, 360 aa, Escherichia coli MS 69-1
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAILNNVYLGGIDNPTSRRYAVITAYNGGAGSVLRVFSNDKIQAANIINTMTPGDVYQTLTTRHPSAESRRYLYKVNTAQKSYRRR

SEQ ID NO: 17304 - protein, 250 aa, Escherichia coli MS 69-1
MINVLICILICCTNAQAGVVVGGTRFVYPEKQSSISVELKNTASKDMLVKISVTPDDGRQLKGTLESQPLLPDKAFIATPPLLVLKQDKNTKIRINRVGGQLPIDRESLFILNIAALPAQEQNSQLKNENQLQVAVRNRMKIFYRPETLSGNPLDAYQQLRWSRNNEAVTVFNPTPWYVTLYNLSIDGKSINGGMVAPFSHRQQDWCQRQGYCEINWQTLDLYNNALPVWSVKLNVLQNNAIMGAVAIHG

SEQ ID NO: 17305 - protein, 386 aa, Escherichia coli MS 69-1
MVDDVPVAQVLQALAEQEKLNLVVSPDVSGTVSLHLTDVPWKQALQTVVKSAGLITRQEGNILSVHSVAWQNDNIARQEAEQARAQANLPLENRNITLQYADAGELAKAGEKLLSAKGSMTVDKRTNRLLLRDNKAALSALEQWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 17306 - protein, 784 aa, Escherichia coli MS 69-1; identical to SEQ ID NO: 6283

SEQ ID NO: 17307 - protein, 150 aa, Escherichia coli MS 69-1
MSFFILPVHAGVVIYGTRIIYPEKNREVLVQLMNQSKNASLIQAWIDDGNTTIAPEKIQVPFILTPPVSRVAGGSGQQLKIRKMPNNLPHNKESLFYLNVLDIPPNNPQNAGKNKIKLALQNRIKLLWRPSGIAPVDKKSLSQLNIKKKK

SEQ ID NO: 17308 - protein, 816 aa, Escherichia coli MS 69-1
MLRTTRWVAAIIFLYSFPGYAEETFDTHFMIGGMRGEKVSEYRFDNKQPLPGNYELDFYVNHQWRGKKDITIPESPAKPCLPKVLLTTLGVKTDNLNTEDNCILLDEAVHGGQYQWDISEHRLNLTVPQAYINELERGYVPPESWDRGIDAFYTSYNLSQYRSYDSNNNSNTASYGRFNSGLNLFSWQLHSDASYSKPDDMKGKWQSNTLYLERGWSQILSTVQIGENHTSSLIFDSLRFSGIRLFRDMQMLPDSMQSFTPLVQGVAQSNALITVSQNGYTIYQKEVPPGPFTIADLQLSGSGSDLDVSIKEADGSVRSFLVPYSSVPNMLQPGVSNFDFIAGRSQIYGVKNQEDFLEANYIYGLNNLLTLYGGMILSDNYNAITLGNGWNTPLGAISFDATRSSSKLNNDTRHEGTSYQVAYNKYLLQTATHFSVAAWRYASQDYRTFSDHLYENDKINHQSDYNDFYDIGRKNSLSANIMQPLSNNLGNVSLSALWRNYWGRSGNAKDYQFSYSNSWQRISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPIAIIDGSYSHSKNTWQSGGSISSGLVVWPGGINITNQLSDTFAILDAPGLEGAHINGQKYNRTNSKGQVVYDLIIPHRENHLVLDIANSESETELQGNRQIIAPYRGAVSYVQFTTNQRKPWYIQALRPDGSPLTFGYDVLDLQENNIGVVGQGSRLFIRVDEIPTGIKVALNDEQNLFCTITFQHVIDENKTYICQ

SEQ ID NO: 17309 - protein, 353 aa, Escherichia coli MS 69-1
MKMKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAWLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRTEAWATGLKYDANNIYLATFYSETRKMTPISGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 17310 - protein, 669 aa, Escherichia coli MS 69-1; identical to SEQ ID NO: 5950

SEQ ID NO: 17311 - protein, 869 aa, Escherichia coli MS 69-1
MKIPTTTDIPQRYSWCLAGICYSSLAILPSFLSYAESYFNPAFLLENGTSVADLSRFERGNHQPAGVYRVDLWRNDEFIGSQDIVFESTTVNTGDKSGGLMPCFNQALLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHSGS

SEQ ID NO: 17312 - protein, 230 aa, Escherichia coli MS 69-1; identical to SEQ ID NO: 6360

SEQ ID NO: 17313 - protein, 629 aa, Escherichia coli MS 69-1
MTVTATGNARSSFEAPMMVSVIDTSAPENQTATSASDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 17314 - protein, 244 aa, Escherichia coli MS 69-1
MWKLSMIRKKILMAAIPLFVISGADAAVSLDRTRAVFDGSEKSMTLDISNDNKQLPYLAQAWIENENQEKIIAGPVIATPPVQRLEPGAKSMVRLSTTPDISKLPQDRESLFYFNLREIPPRSEKANVLQIALQTKIKLFYRPAAIKTRPNEVWQDQLILNKVSDGYRIENPTPYYVTVIGLGGSEKQAEEGEFETVMLSPRSEQTVKSANYNTPYLSYINDYGGRPVLSFICNGSRCSVKKEK

SEQ ID NO: 17315 - protein, 836 aa, Escherichia coli MS 69-1
MKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSIARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 17316 - protein, 733 aa, Escherichia coli MS 69-1
MAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQAIGDTTAVRLNVMGEKTHDAGRDKIKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDNSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRFHPGEPRTFLLTANMHF

SEQ ID NO: 17317 - protein, 331 aa, Escherichia coli MS 69-1; identical to SEQ ID NO: 6551

SEQ ID NO: 17318 - protein, 431 aa, Escherichia coli MS 69-1; identical to SEQ ID NO: 6791

SEQ ID NO: 17319 - protein, 803 aa, Escherichia coli MS 69-1
MAMPCALAVEFNLNVLDKSMRDRIDISLLKEKGVIAPGEYFVSVAVNNNQISNGQKINWQKKGDKTIPCINDSLVDKFGLKPDIRQSLPQIDRCIDFSSRPEMLFNFDQANQQLNITIPQAWLAWHSDNWTPPSTWKEGVAGVLMDYNLFASSYRPQDGSNSTNLNAYGTAGINAGAWRLRSDYQLNQTDSDDNHEQSGEISRTYLFRPLPQLGSKLTLGETDFSSNIFDGFSYTGAALASDDRMLPWELRGYAPQISGIAQTNATVTVSHSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISGDDYHSAAMGIGQNMLWLGALSFDVTWASSQFDTQQDERGLSYRFNYSKQVDATNSTISLAAYRFSDRHFHSYANYLDHKYNDNDAQDEKQTISLSVGQPITPLNFNLYANLLHQTWWNADASTTANITAGFNVDIGNWRDISISTSFNTTHYEDKDRDNQIYLSISLPFGNGGRVGYDMQNSNHSTTHRMSWNDTLDERNSWGMSTGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVSVNMNDLPDGVTVADNVIKETWIEGAIGYKSLASRSGKDVNVIIRNASGQFPPLGADIRQDDSGISVGMVGEEGHAWLSGVAENQQFTVVWGDSQRCSIHLPEHMEDTANRLILPCH

SEQ ID NO: 17320 - protein, 243 aa, Escherichia coli MS 69-1
MTFMKGLPLLLLIASLCSYAALQPDRTRIVFNANDKATSLRVDNRSDKLPYLAYSWLENEKGEKSDDLLVALPPIQRLEPKATTQVRIVKQASTAKLPGDRETLFFYNMREIPPSPEKNSGHAVLQVAIQSRIKVFWRPSALRKKAGEKVELQLQVSQQGNQLNLKNPTGYYLTIAYLGRNEQAVLPGFKTVMVAPFSTVITNTGSYSGSQFYLGYMDDYGALRMTTLNCNGHCRLQAVEAKK

SEQ ID NO: 17321 - protein, 243 aa, Escherichia coli MS 69-1; identical to SEQ ID NO: 14800

SEQ ID NO: 17322 - protein, 337 aa, Escherichia coli MS 69-1
MPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 17323 - protein, 224 aa, Escherichia coli MS 69-1
MKGLLALLISSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSINVKSNNANNWYLTIIDDHGNYISDKI

SEQ ID NO: 17324 - protein, 831 aa, Escherichia coli MS 69-1
MQELPMLRMTPLASAIVALLLGIEAYAAEETFDTHFMIGGMKDQQVANIRLDDNQPLPGQYDIDIYVNKQWRGKYEIIVKDNPQETCISREIIKRLGINTDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNSNPGGWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVTTPRRQIYMSNSTTFDDQGFASNNTGLSGTVGSRDQFNYGVNLSHQHQGNETTAGANLTWNAPVATVNGSYSQSSTYRQAGASVSGGIVAWSEGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRTDGQPLTFGYEVNDIHGHNIGVVGQGSQLFIRTNEVPPSVNVAINKQQGLSCTITFGKEIDESRNYICQ

SEQ ID NO: 17325 - protein, 368 aa, Escherichia coli MS 69-1
MNKTITALTIIMASFAANASVLPETPVPFKSGTGAIDNDTVYIGLGSAGTAWYKLDTQAKNKSWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGMSNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 17326 - protein, 241 aa, Escherichia coli MS 69-1
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKRENILRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVME

SEQ ID NO: 17327 - protein, 878 aa, Escherichia coli MS 69-1
MSYLNLRLYQRNTQCLHIRKHRLAGLFVRLFVACAFAAQAPLSSAELYFNPRFLADDPQAVADLSRFENGQELPPGTYRVDIYLNNAYMATRDVTFNTGDSEQGIVPCLTRVQLASMGLNTASVSGMNLLADDACVPLTSMIHDATAHLDVGQQRLNLTIPQAFMSNRARGYIPPELWDPGINAGLLNYNFSGNSVQNRIGSNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 17328 - protein, 446 aa, Escherichia coli MS 69-1; identical to SEQ ID NO: 15762

SEQ ID NO: 17329 - protein, 237 aa, Escherichia coli MS 69-1
MRKITQAISAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVHRGDAIFFVTGRSPTKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 17330 - protein, 478 aa, Escherichia coli MS 69-1; identical to SEQ ID NO: 8063

SEQ ID NO: 17331 - protein, 840 aa, Escherichia coli MS 69-1
MNNKNTFTGDKLSHAIKIALSGVVCSLLFVLPVHAVEFNVDMIDVEDRENIDISRFEKKGYITPGKYLVRVQINKNMLPQTLILEWVKADNESGSLLCLTKENLTSFGLNTEFIESLQTIAGSECLNLSQRQELTTRLDKATMILSLSVPQAWLKYQATNWTPPEFWDAGIAGFILDYNMYASQYAPHHGDSTQNVSSYGTLGFNLGAWRLRSDYQYNQNFADGRSVNHDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSDNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTVTRHGVALHDYSYGDNARMMVDTDGISGVEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSILHLTWGDNTCEVTPPNQSNISESAIILPCKTVK

SEQ ID NO: 17332 - protein, 249 aa, Escherichia coli MS 69-1; identical to SEQ ID NO: 5852

SEQ ID NO: 17333 - protein, 364 aa, Escherichia coli MS 69-1; identical to SEQ ID NO: 6259

SEQ ID NO: 17334 - protein, 162 aa, Escherichia coli MS 69-1; identical to SEQ ID NO: 8101

SEQ ID NO: 17335 - protein, 204 aa, Escherichia coli MS 69-1
MMKKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVEAAKFTFTPPQGVTVDDQRK

SEQ ID NO: 17336 - protein, 357 aa, Escherichia coli MS 69-1; identical to SEQ ID NO: 5807

SEQ ID NO: 17337 - protein, 233 aa, Escherichia coli MS 69-1
MKTCITKGIVTVSLTAILLSCSFTWAAGKGGVGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLPYPLAEAPAKLRCTSSADMVTVSNPTPYFITLTDLKIGGKVVKNQMISPFDKYQFPLPKGAQNSSVTYRTINDYGAETPQLNCKS

SEQ ID NO: 17338 - protein, 851 aa, Escherichia coli MS 69-1
MPSFIGGLVVFVSAAFNAQAETWFDPAFFKDDPSMVADLSRFERGQKITPRVYRVDIVLNQTMVDTRNVNFVEITPEKGIAACLTTESLDAMGVNIDAFLAFKQLDKQACAPLAEIIPDASVTFNVNKLRLEISVPQIAIKSNARGYVPPERWDEGINALLLGYSFSGANSIHRSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSINSYSVPFSSVPLLQRQGRIKYAVTLAKYRTNSNDQQESKFAQATLQWGGPWGTTWYGGGQYAEYYRAAMLGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGDYGSFYLSGSQQTYWHTDQQDRLLQFGYNTQIKDLSLGVSWNYSKSRGQPDADQVFALNFSLPLNLLLSRSNDSYTRKKNYAWMTSNTSIDNEGHTTQNLGLTETLLDDGNLSYSVQQGYNSEGKTANGSASMDYKGAFADARVGYNYSDSGSQQQLNYALSGSLVAHSRGITLGQSLGETNVLIAAPGAENTRVANSTGLKTDWRGYTVVPYATSYRENRIVLDAASLKRNVDLENAVVNVVPTKGALVLAEFNAHAGGRVLMKTSTQGIPLRFGAIATLDGVQTNSGIIDDDGSLYMSGLPAQGAITVRWGEAPDQICHISYQLTEQQINAAITRMDAICR

SEQ ID NO: 17339 - protein, 236 aa, Escherichia coli MS 69-1
MTNTWNRLTLAIFAVLSLLVAGELQAGVVVGGTRFIFPADSESISISLTNTSQESWLINSKINRPTRWAGGEASTVPAPLLAAPPLILLKPGTTGTLRLLRTESGILPVDRETLFELSIASVPSGKVENQSVKVAMRSIFKLFWRPEGLPGDPLEAYQQLRWTRNSQGVQLTNPTPYYINLIQVSVNGKALSNAGVVPPKSQRQTSWCQAIAPCHVSWRTINDYGGLSAKKEQNLL

SEQ ID NO: 17340 - protein, 517 aa, Escherichia coli MS 69-1
MKHKLQMMKMRWLSAAVMLTLYTSSSWAFSIDDVAKQAQSLAGKGYDAPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 17341 - protein, 191 aa, Escherichia coli MS 69-1; identical to SEQ ID NO: 14762

SEQ ID NO: 17342 - protein, 235 aa, Escherichia coli MS 69-1; identical to SEQ ID NO: 6404

SEQ ID NO: 17343 - protein, 729 aa, Escherichia coli MS 69-1
MLSTQFNRDNQYQTTSKPSLLAACIALALLPSAAFAAPATEETVIVEGSATTPVDDENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADIQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGKTAYKAVDGTVSKGVEFELNGAITDNWQLTFGATRYIAEDNEGNAVNPNLPRTTVKMFTSYRLPVMPELTVGGGVNWQNRVYTDTVTPYDTFRAEQGSYALVDLFTRYQVTKNFSLQGNVNNLFDKTYDTNVEGSIVYGAPRNFSITGTYQF

SEQ ID NO: 17344 - protein, 213 aa, Escherichia coli MS 69-1; identical to SEQ ID NO: 5744

SEQ ID NO: 17345 - protein, 614 aa, Escherichia coli MS 69-1
MIKKASLLTAFSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRIEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVTVGHGNIGAGVDWQKQSTAPGTAYVKDGYDQRNTGIYLTGLQQVGDFTFEGAARSDDNSQFGRHGTWQTSAGWEFIEGYRFIASYGTSYKAPNLGQLYGFYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 17346 - protein, 219 aa, Escherichia coli MS 69-1
MSLNFTVIVWLRLSIGGVYVLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSSGKKLTVDKRLLQCGNEIYSAIKDLQSKAPDKNIVIFTHNHCLTYIAKDKRDATFKPDYLDGLVMHVEKGKVYLDGEFVNH

SEQ ID NO: 17347 - protein, 274 aa, Escherichia coli MS 69-1; identical to SEQ ID NO: 8643

SEQ ID NO: 17348 - protein, 249 aa, Escherichia coli MS 69-1; identical to SEQ ID NO: 8118

SEQ ID NO: 17349 - protein, 883 aa, Escherichia coli MS 69-1; identical to SEQ ID NO: 8645

SEQ ID NO: 17350 - protein, 518 aa, Escherichia coli MS 69-1; identical to SEQ ID NO: 15742

SEQ ID NO: 17351 - protein, 208 aa, Escherichia coli MS 69-1; identical to SEQ ID NO: 5717

SEQ ID NO: 17352 - protein, 746 aa, Escherichia coli MS 69-1
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYSLTWNGGWDNGVTTSNWVQYEHTRNSRIPEGLAGGTEGKFNEKATQDFVDIDLDDVMLHSEVNLPIDFLINQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 17353 - protein, 366 aa, Escherichia coli MS 69-1; identical to SEQ ID NO: 7432

SEQ ID NO: 17354 - protein, 161 aa, Escherichia coli MS 69-1; identical to SEQ ID NO: 5769

SEQ ID NO: 17355 - protein, 266 aa, Escherichia coli MS 69-1; identical to SEQ ID NO: 8089

SEQ ID NO: 17356 - protein, 747 aa, Escherichia coli MS 69-1; identical to SEQ ID NO: 8088

SEQ ID NO: 17357 - protein, 228 aa, Escherichia coli MS 69-1
MAFSMPVMADIVISGTRVIYKSDQKSVSVRLENKGNSHLLVQSWLDTGDDNAEPGSINVPFTATPPVSRIDAKRGQTIKLMYTGSTVLPSDKESVFWFNVLEVPPKPDASKVENQSLLQLAFRTRIKLFYRPAGLNGNPSEAPLALKWKWAEGKSGLSVYNPTPYYVSFNNAELIAGGKSNPLNVKMVAPKSEEIFTISGSGGKATSGKVHFSAINDFGGAIEGDVNL

SEQ ID NO: 17358 - protein, 635 aa, Escherichia coli MS 69-1
MNRYVQRDITAIRSQLIMGESYTTGETFDSVSIRGIRLYSDSRMLPPVLANFAPTIRGVANTNAKVSITQSGYKIYETTVPPGPFVIDDLSPSGYGSDLIVTIEEADGSKRTFSQPFSSVIQMLRPGVSRWDISGGQINKDDLHHEPNLLQATYYRGLSNLFTGYTGFQVTDNHYAAGLLGIGMNTSVGAISFDVTHSSVDIPDDKRYQGQSYRISWNKFFDLTDTSLNIAAYRYSTQDYLGLNDALTLIDEVEHPTQDLDPKTMRNYGRMKNQFTVSINQPLRFGKDDYGSFYTSGSWSDYWGGSKSRSNYSVGYSNSASWGSYSISAQRSWDEYSQTENSIYLSFSIPIEKLMGTEHRDSGFQSIDTQLSTNMDGNNQFNMSSSGYSNDNRVSYSVNAGYGMNKTGKDLSNIGGYASYESPWGTLAGSVSATSDNNRQYSVNTDGGFVLHSGGLTFSNDSFSDNDTIALVKAPGAKGARINYGNNTVDRWGYGVTSALSPYQENKIALDTENLENDIEMKSTSTVAVPRQGSVIFAGFETNQGQSAIMNIKRSDGKGIPFAADIHDETNAIIGNVGQGGQAFVRGIQQQGTIKITWLEASMPKTCIAQYQQPNVTSEKIQQTIILNNILCQLQ

SEQ ID NO: 17359 - protein, 122 aa, Escherichia coli MS 69-1; identical to SEQ ID NO: 5737

SEQ ID NO: 17360 - protein, 111 aa, Escherichia coli MS 69-1; identical to SEQ ID NO: 5889

SEQ ID NO: 17361 - protein, 700 aa, Escherichia coli MS 69-1
MKIFSVRQTVLPALLVLSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVITQTGQQPPTIEASSYYGSFGSWRYGLKATGAMGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYVTSGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGMNIAWRFE

SEQ ID NO: 17362 - protein, 567 aa, Escherichia coli MS 69-1
MKIKLRITIILISALCIFNGLLTPGAYAATANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGGGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 17363 - protein, 432 aa, Escherichia coli MS 69-1; identical to SEQ ID NO: 5727

SEQ ID NO: 17364 - protein, 166 aa, Escherichia coli MS 78-1
MNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 17365 - protein, 243 aa, Escherichia coli MS 78-1; identical to SEQ ID NO: 6145

SEQ ID NO: 17366 - protein, 353 aa, Escherichia coli MS 78-1; identical to SEQ ID NO: 15514

SEQ ID NO: 17367 - protein, 252 aa, Escherichia coli MS 78-1; identical to SEQ ID NO: 7371

SEQ ID NO: 17368 - protein, 834 aa, Escherichia coli MS 78-1; identical to SEQ ID NO: 15406

SEQ ID NO: 17369 - protein, 432 aa, Escherichia coli MS 78-1; identical to SEQ ID NO: 5727

SEQ ID NO: 17370 - protein, 204 aa, Escherichia coli MS 78-1; identical to SEQ ID NO: 5755

SEQ ID NO: 17371 - protein, 365 aa, Escherichia coli MS 78-1; identical to SEQ ID NO: 7931

SEQ ID NO: 17372 - protein, 700 aa, Escherichia coli MS 78-1
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPVGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 17373 - protein, 883 aa, Escherichia coli MS 78-1; identical to SEQ ID NO: 15417

SEQ ID NO: 17374 - protein, 224 aa, Escherichia coli MS 78-1; identical to SEQ ID NO: 10987

SEQ ID NO: 17375 - protein, 111 aa, Escherichia coli MS 78-1; identical to SEQ ID NO: 7885

SEQ ID NO: 17376 - protein, 362 aa, Escherichia coli MS 78-1; identical to SEQ ID NO: 5809

SEQ ID NO: 17377 - protein, 231 aa, Escherichia coli MS 78-1; identical to SEQ ID NO: 15408

SEQ ID NO: 17378 - protein, 813 aa, Escherichia coli MS 78-1; identical to SEQ ID NO: 16653

SEQ ID NO: 17379 - protein, 686 aa, Escherichia coli MS 78-1
MFWRDITLSVWRKKTTDLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 17380 - protein, 541 aa, Escherichia coli MS 78-1; identical to SEQ ID NO: 6286

SEQ ID NO: 17381 - protein, 207 aa, Escherichia coli MS 78-1; identical to SEQ ID NO: 5743

SEQ ID NO: 17382 - protein, 554 aa, Escherichia coli MS 78-1; identical to SEQ ID NO: 16614

SEQ ID NO: 17383 - protein, 236 aa, Escherichia coli MS 78-1; identical to SEQ ID NO: 6643

SEQ ID NO: 17384 - protein, 851 aa, Escherichia coli MS 78-1; identical to SEQ ID NO: 8686

SEQ ID NO: 17385 - protein, 166 aa, Escherichia coli MS 78-1
MTPDNKKSADFIITPPLFVLNPANENLLRIMYIGAPLAKDRETLFFTSVRAVPSTTKREEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 17386 - protein, 122 aa, Escherichia coli MS 78-1; identical to SEQ ID NO: 5737

SEQ ID NO: 17387 - protein, 405 aa, Escherichia coli MS 78-1
MKIIITREYIMKRKVLAMLVPALLVAGAANAAEVYNKDGNKLDLYGKVAGLHYFSDDAGSDGDMSYARIGFKGETQIADQFTGYGQWEYNLQANGTEGDGDNSATRLAFAGLGFGQNGTFDYGRNYGVVYDIEAWTDMLPEFGGDTYAGADNFMNGRTNGVAIYRNNGFFGQVDGLNFALQYQGNNEGSGDGFLFGQEGSGSGDGRKLSKENGDGYGMSTSYNFDFGLSFGAAYSNSDRTDEQTKPDFHNTRAGDRNDITAGGETAEAWTVGAKYDANNVYLAAMYAETRNMTGYGDANAIANKTQNFEVVAQYQFDFGLRPSIAYLQSKGKDLGGWAHDGNGDPRYTNKDLVKYVEVGATYYFNKNMSTYVDYKINLLDNDDDFYEANGIATDDIVAVGLVYQF

SEQ ID NO: 17388 - protein, 751 aa, Escherichia coli MS 78-1
MDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYATLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSIGITSMWVMTGKFI

SEQ ID NO: 17389 - protein, 230 aa, Escherichia coli MS 78-1
MMTKIKLLMLIIFYLIISASSHAAGGIALGATRIIYPADAKQTAVWIRNSHTNERFLVNSWIENSSGVKEKSFIITPPLFVSEPKSDNTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVSSQIPLPSGVQGKLKFQTVNDYGSVTPVREVNLN

SEQ ID NO: 17390 - protein, 245 aa, Escherichia coli MS 78-1; identical to SEQ ID NO: 15432

SEQ ID NO: 17391 - protein, 819 aa, Escherichia coli MS 78-1
MDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNISIPQAWLAWHSENWTPPSTWKEGVAGILMDYNLFASSYRPQDGSSSTNLNAYGTTGINAGAWRLRSDYQLNQTDSDDNHEQSGGISRTYLFRPLPQLGSKLTLGETDFSSNIFDGFSYTGAALASDERMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGTLSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDGSGISVGMVGEEGHAWLSGVAENQQFTVVWGDSQHCSLHLPEHMEDTANRLILPCH

SEQ ID NO: 17392 - protein, 431 aa, Escherichia coli MS 78-1; identical to SEQ ID NO: 6791

SEQ ID NO: 17393 - protein, 331 aa, Escherichia coli MS 78-1; identical to SEQ ID NO: 6456

SEQ ID NO: 17394 - protein, 760 aa, Escherichia coli MS 78-1; identical to SEQ ID NO: 6455

SEQ ID NO: 17395 - protein, 368 aa, Escherichia coli MS 78-1
MNKTITALAIMMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAVDKINAHYFDKKAEDYFFNKFLLSFDPSTQQWSYAGESPWYGTAGAAVVNKGDKTWLINGEAKPGLRTDAVFELDFTGNNLKWNKLASVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 17396 - protein, 241 aa, Escherichia coli MS 78-1
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAVTRVLENALVPPMGESTVKLPSDAGSNITYRTINDYGALTPKMTGVME

SEQ ID NO: 17397 - protein, 790 aa, Escherichia coli MS 78-1
MATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 17398 - protein, 208 aa, Escherichia coli MS 78-1; identical to SEQ ID NO: 5717

SEQ ID NO: 17399 - protein, 213 aa, Escherichia coli MS 78-1; identical to SEQ ID NO: 5744

SEQ ID NO: 17400 - protein, 729 aa, Escherichia coli MS 78-1; identical to SEQ ID NO: 6500

SEQ ID NO: 17401 - protein, 235 aa, Escherichia coli MS 78-1; identical to SEQ ID NO: 6404

SEQ ID NO: 17402 - protein, 191 aa, Escherichia coli MS 78-1; identical to SEQ ID NO: 5748

SEQ ID NO: 17403 - protein, 517 aa, Escherichia coli MS 78-1; identical to SEQ ID NO: 6817

SEQ ID NO: 17404 - protein, 663 aa, Escherichia coli MS 78-1; identical to SEQ ID NO: 8669

SEQ ID NO: 17405 - protein, 169 aa, Escherichia coli MS 78-1; identical to SEQ ID NO: 8240

SEQ ID NO: 17406 - protein, 374 aa, Escherichia coli MS 78-1; identical to SEQ ID NO: 5608

SEQ ID NO: 17407 - protein, 219 aa, Escherichia coli MS 78-1; identical to SEQ ID NO: 6490

SEQ ID NO: 17408 - protein, 274 aa, Escherichia coli MS 78-1; identical to SEQ ID NO: 6549

SEQ ID NO: 17409 - protein, 250 aa, Escherichia coli MS 78-1; identical to SEQ ID NO: 6317

SEQ ID NO: 17410 - protein, 575 aa, Escherichia coli MS 78-1
MTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNREDKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLSDGSHPPFGAEVKNDNEQTVSLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 17411 - protein, 774 aa, Escherichia coli MS 78-1
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDANRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 17412 - protein, 746 aa, Escherichia coli MS 78-1; identical to SEQ ID NO: 6296

SEQ ID NO: 17413 - protein, 831 aa, Escherichia coli MS 78-1; identical to SEQ ID NO: 16644

SEQ ID NO: 17414 - protein, 213 aa, Escherichia coli MS 78-1; identical to SEQ ID NO: 12304

SEQ ID NO: 17415 - protein, 386 aa, Escherichia coli MS 78-1; identical to SEQ ID NO: 7993

SEQ ID NO: 17416 - protein, 161 aa, Escherichia coli MS 78-1; identical to SEQ ID NO: 5769

SEQ ID NO: 17417 - protein, 266 aa, Escherichia coli MS 78-1; identical to SEQ ID NO: 5772

SEQ ID NO: 17418 - protein, 737 aa, Escherichia coli MS 78-1
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAER

SEQ ID NO: 17419 - protein, 230 aa, Escherichia coli MS 78-1; identical to SEQ ID NO: 7855

SEQ ID NO: 17420 - protein, 825 aa, Escherichia coli MS 78-1
MGQNASNIDLSRYSEGNPAIPDMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDETNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 17421 - protein, 784 aa, Escherichia coli MS 78-1; identical to SEQ ID NO: 12980

SEQ ID NO: 17422 - protein, 219 aa, Escherichia coli MS 78-1
MSFFILPVHAGVVIYGTRIIYPEKNREVLVQLMNQSKNASLIQAWIDDGNTTIAPEKIQVPFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSNSDITLKNNNASEYELTVVDDYGNNIHSKIAAR

SEQ ID NO: 17423 - protein, 816 aa, Escherichia coli MS 78-1
MLRTTRWVAAIIFLYSFPGYAEETFDTHFMIGGMRGEKVSEYRFDNKQPLPGNYELDVYVNHQWRGKQDITIPESPAKPCLPKVLLTTLGVKTDNLNTEDNCILLDEAVHGGQYQWDISEHRLNLTIPQAYINELERGYVPPESWDRGIDAFYTSYNLSQYRSYDSNNNSNTASYGRFNSGLNLFSWQLHSDASYSKPDDMKGTWQSNTLYLERGWSQILSTVQIGENYTSSLIFDSLRFSGIRLFRDMQMLPDSMQSFTPLVQGVAQSNALITVSQNGYIIYQKEVPPGPFTIADLQLSGSGADLDVSIKEADGSVRSFLVPYSSVPNMLQPGVSNFDFIAGRSKIYGVKNQEDFLEANYIYGLNNLLTLYGGTILSDNYNAITLGNGWNTPLGAISFDATRSSSKLNNDITHEGTSYQVAYNKYLVQTATRFSVAAWRYASQDYRTFSDHLYENDKHNHQSEYDDFYDIGRKNSLSANIMQPLSNNLGNVSLSALWRNYWGRSGNAKDYQFSYSNSWQRISYTFSASQSYDENDKEEERFNLFISIPFYWGDDITKTRHQINLSNSTSFSKDGYSSNNTGVTGIAGEHDQLNYGIYVNQQQQNNDTSLGTNLSWRTPIAIIDGSYSHSKNTWQSGGSISSGLVVWPGGINITNQLSDTFAILDAPGLEGAHINGQKYNRSNSKGQVVYDLMIPHRENHLVLDIANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 17424 - protein, 518 aa, Escherichia coli MS 78-1; identical to SEQ ID NO: 6358

SEQ ID NO: 17425 - protein, 360 aa, Escherichia coli MS 78-1
MMKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSGLRGFLNDKIQAANIINTMTPGDVYQTLTTRHPSAESRRYLYKVNTAQKSYRRR

SEQ ID NO: 17426 - protein, 478 aa, Escherichia coli MS 78-1; identical to SEQ ID NO: 8471

SEQ ID NO: 17427 - protein, 446 aa, Escherichia coli MS 78-1; identical to SEQ ID NO: 6459

SEQ ID NO: 17428 - protein, 784 aa, Escherichia coli MS 79-10; identical to SEQ ID NO: 6283

SEQ ID NO: 17429 - protein, 132 aa, Escherichia coli MS 79-10; identical to SEQ ID NO: 15573

SEQ ID NO: 17430 - protein, 122 aa, Escherichia coli MS 79-10; identical to SEQ ID NO: 5737

SEQ ID NO: 17431 - protein, 446 aa, Escherichia coli MS 79-10; identical to SEQ ID NO: 6459

SEQ ID NO: 17432 - protein, 478 aa, Escherichia coli MS 79-10; identical to SEQ ID NO: 5711

SEQ ID NO: 17433 - protein, 834 aa, Escherichia coli MS 79-10; identical to SEQ ID NO: 8715

SEQ ID NO: 17434 - protein, 252 aa, Escherichia coli MS 79-10; identical to SEQ ID NO: 7371

SEQ ID NO: 17435 - protein, 432 aa, Escherichia coli MS 79-10; identical to SEQ ID NO: 5727

SEQ ID NO: 17436 - protein, 231 aa, Escherichia coli MS 79-10; identical to SEQ ID NO: 15878

SEQ ID NO: 17437 - protein, 813 aa, Escherichia coli MS 79-10; identical to SEQ ID NO: 15877

SEQ ID NO: 17438 - protein, 204 aa, Escherichia coli MS 79-10; identical to SEQ ID NO: 5755

SEQ ID NO: 17439 - protein, 431 aa, Escherichia coli MS 79-10; identical to SEQ ID NO: 6791

SEQ ID NO: 17440 - protein, 331 aa, Escherichia coli MS 79-10; identical to SEQ ID NO: 15860

SEQ ID NO: 17441 - protein, 760 aa, Escherichia coli MS 79-10; identical to SEQ ID NO: 6455

SEQ ID NO: 17442 - protein, 663 aa, Escherichia coli MS 79-10; identical to SEQ ID NO: 6307

SEQ ID NO: 17443 - protein, 828 aa, Escherichia coli MS 79-10; identical to SEQ ID NO: 7891

SEQ ID NO: 17444 - protein, 169 aa, Escherichia coli MS 79-10; identical to SEQ ID NO: 8240

SEQ ID NO: 17445 - protein, 345 aa, Escherichia coli MS 79-10
VYNKDGNKLDLYGKVDGLHYFSDNKDVDGDQTYMRLGFKGETQVTDQLTGYGQWEYQIQGGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVNGEGMTNNGRDALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGTIAGRNYDDEDILKYVDVGATYYFNKNMSTYVDYKINLLDDNQFTRDAGINTDNIVALGLVYQF

SEQ ID NO: 17446 - protein, 111 aa, Escherichia coli MS 79-10; identical to SEQ ID NO: 7885

SEQ ID NO: 17447 - protein, 386 aa, Escherichia coli MS 79-10; identical to SEQ ID NO: 7993

SEQ ID NO: 17448 - protein, 208 aa, Escherichia coli MS 79-10; identical to SEQ ID NO: 5717

SEQ ID NO: 17449 - protein, 746 aa, Escherichia coli MS 79-10; identical to SEQ ID NO: 10445

SEQ ID NO: 17450 - protein, 230 aa, Escherichia coli MS 79-10; identical to SEQ ID NO: 7352

SEQ ID NO: 17451 - protein, 869 aa, Escherichia coli MS 79-10; identical to SEQ ID NO: 10176

SEQ ID NO: 17452 - protein, 843 aa, Escherichia coli MS 79-10; identical to SEQ ID NO: 6288

SEQ ID NO: 17453 - protein, 228 aa, Escherichia coli MS 79-10; identical to SEQ ID NO: 6185

SEQ ID NO: 17454 - protein, 747 aa, Escherichia coli MS 79-10; identical to SEQ ID NO: 6343

SEQ ID NO: 17455 - protein, 266 aa, Escherichia coli MS 79-10; identical to SEQ ID NO: 5772

SEQ ID NO: 17456 - protein, 161 aa, Escherichia coli MS 79-10; identical to SEQ ID NO: 5769

SEQ ID NO: 17457 - protein, 517 aa, Escherichia coli MS 79-10; identical to SEQ ID NO: 6817

SEQ ID NO: 17458 - protein, 191 aa, Escherichia coli MS 79-10; identical to SEQ ID NO: 5748

SEQ ID NO: 17459 - protein, 235 aa, Escherichia coli MS 79-10; identical to SEQ ID NO: 15868

SEQ ID NO: 17460 - protein, 267 aa, Escherichia coli MS 79-10; identical to SEQ ID NO: 15862

SEQ ID NO: 17461 - protein, 836 aa, Escherichia coli MS 79-10; identical to SEQ ID NO: 14687

SEQ ID NO: 17462 - protein, 233 aa, Escherichia coli MS 79-10; identical to SEQ ID NO: 6327

SEQ ID NO: 17463 - protein, 591 aa, Escherichia coli MS 79-10; identical to SEQ ID NO: 7870

SEQ ID NO: 17464 - protein, 236 aa, Escherichia coli MS 79-10; identical to SEQ ID NO: 6329

SEQ ID NO: 17465 - protein, 356 aa, Escherichia coli MS 79-10
MLDTRKLYSQSWDAGLRYNGELIKSQLITSYSHSKDYNYDPHFGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 17466 - protein, 518 aa, Escherichia coli MS 79-10; identical to SEQ ID NO: 7565

SEQ ID NO: 17467 - protein, 554 aa, Escherichia coli MS 79-10; identical to SEQ ID NO: 15864

SEQ ID NO: 17468 - protein, 207 aa, Escherichia coli MS 79-10; identical to SEQ ID NO: 5743

SEQ ID NO: 17469 - protein, 368 aa, Escherichia coli MS 79-10; identical to SEQ ID NO: 7974

SEQ ID NO: 17470 - protein, 360 aa, Escherichia coli MS 79-10; identical to SEQ ID NO: 15847

SEQ ID NO: 17471 - protein, 121 aa, Escherichia coli MS 79-10; identical to SEQ ID NO: 9139

SEQ ID NO: 17472 - protein, 856 aa, Escherichia coli MS 79-10; identical to SEQ ID NO: 15887

SEQ ID NO: 17473 - protein, 245 aa, Escherichia coli MS 79-10; identical to SEQ ID NO: 15432

SEQ ID NO: 17474 - protein, 819 aa, Escherichia coli MS 79-10; identical to SEQ ID NO: 6642

SEQ ID NO: 17475 - protein, 883 aa, Escherichia coli MS 79-10; identical to SEQ ID NO: 15903

SEQ ID NO: 17476 - protein, 224 aa, Escherichia coli MS 79-10; identical to SEQ ID NO: 15902

SEQ ID NO: 17477 - protein, 219 aa, Escherichia coli MS 79-10; identical to SEQ ID NO: 6490

SEQ ID NO: 17478 - protein, 700 aa, Escherichia coli MS 79-10; identical to SEQ ID NO: 15857

SEQ ID NO: 17479 - protein, 541 aa, Escherichia coli MS 79-10; identical to SEQ ID NO: 6286

SEQ ID NO: 17480 - protein, 861 aa, Escherichia coli MS 79-10; identical to SEQ ID NO: 15874

SEQ ID NO: 17481 - protein, 250 aa, Escherichia coli MS 79-10; identical to SEQ ID NO: 10481

SEQ ID NO: 17482 - protein, 274 aa, Escherichia coli MS 79-10; identical to SEQ ID NO: 7373

SEQ ID NO: 17483 - protein, 353 aa, Escherichia coli MS 79-10; identical to SEQ ID NO: 15872

SEQ ID NO: 17484 - protein, 498 aa, Escherichia coli MS 79-10; identical to SEQ ID NO: 15749

SEQ ID NO: 17485 - protein, 230 aa, Escherichia coli MS 79-10; identical to SEQ ID NO: 7855

SEQ ID NO: 17486 - protein, 825 aa, Escherichia coli MS 79-10; identical to SEQ ID NO: 15849

SEQ ID NO: 17487 - protein, 331 aa, Escherichia coli MS 79-10; identical to SEQ ID NO: 15895

SEQ ID NO: 17488 - protein, 831 aa, Escherichia coli MS 79-10; identical to SEQ ID NO: 15893

SEQ ID NO: 17489 - protein, 160 aa, Escherichia coli MS 79-10
MVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVNKKMTQLIG

SEQ ID NO: 17490 - protein, 729 aa, Escherichia coli MS 79-10; identical to SEQ ID NO: 15869

SEQ ID NO: 17491 - protein, 213 aa, Escherichia coli MS 79-10; identical to SEQ ID NO: 5744

SEQ ID NO: 17492 - protein, 541 aa, Escherichia coli MS 84-1; identical to SEQ ID NO: 6286

SEQ ID NO: 17493 - protein, 700 aa, Escherichia coli MS 84-1; identical to SEQ ID NO: 13012

SEQ ID NO: 17494 - protein, 673 aa, Escherichia coli MS 84-1; identical to SEQ ID NO: 6170

SEQ ID NO: 17495 - protein, 266 aa, Escherichia coli MS 84-1; identical to SEQ ID NO: 5772

SEQ ID NO: 17496 - protein, 161 aa, Escherichia coli MS 84-1; identical to SEQ ID NO: 5769

SEQ ID NO: 17497 - protein, 169 aa, Escherichia coli MS 84-1; identical to SEQ ID NO: 8240

SEQ ID NO: 17498 - protein, 663 aa, Escherichia coli MS 84-1; identical to SEQ ID NO: 16280

SEQ ID NO: 17499 - protein, 239 aa, Escherichia coli MS 84-1; identical to SEQ ID NO: 16265

SEQ ID NO: 17500 - protein, 831 aa, Escherichia coli MS 84-1; identical to SEQ ID NO: 16264

SEQ ID NO: 17501 - protein, 682 aa, Escherichia coli MS 84-1; identical to SEQ ID NO: 15155

SEQ ID NO: 17502 - protein, 244 aa, Escherichia coli MS 84-1; identical to SEQ ID NO: 6111

SEQ ID NO: 17503 - protein, 836 aa, Escherichia coli MS 84-1
MKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNITSVDLKRLPDDVEATRSVVESALTEGAIGYRKFSVLKGKRLFAILRLADGSQPPFGASVTSEKGRELGMVADEGLAWLSGVTPGETLSVNWDEKIQCQVNVPETAISDQQLLLPCTPQK

SEQ ID NO: 17504 - protein, 517 aa, Escherichia coli MS 84-1; identical to SEQ ID NO: 6817

SEQ ID NO: 17505 - protein, 191 aa, Escherichia coli MS 84-1; identical to SEQ ID NO: 5748

SEQ ID NO: 17506 - protein, 235 aa, Escherichia coli MS 84-1; identical to SEQ ID NO: 6404

SEQ ID NO: 17507 - protein, 729 aa, Escherichia coli MS 84-1; identical to SEQ ID NO: 6531

SEQ ID NO: 17508 - protein, 213 aa, Escherichia coli MS 84-1; identical to SEQ ID NO: 5744

SEQ ID NO: 17509 - protein, 353 aa, Escherichia coli MS 84-1; identical to SEQ ID NO: 15872

SEQ ID NO: 17510 - protein, 774 aa, Escherichia coli MS 84-1; identical to SEQ ID NO: 16243

SEQ ID NO: 17511 - protein, 836 aa, Escherichia coli MS 84-1
MAACTLLYTGNTEARTYSFDASMLKGGGKGVDLTLFEEGAQLPGIYPVDIILNGSRVDSRDMAFRTEKDAEGKTYLKTCLTREMLARYGVMTEEYPELFHGDDGKEADACAELSVIPQATETYQFASQQLLLSIPQVALRPPLRGIAPEALWDDGIPAFLLNWQANTSRSEYRGYGKSVTDNYWVTLEPGINLGPWRVRNLTTWNRSSGQPGQWESAYIRAERGINSLRSRLTLGEDYTPSDIFDSVPFRGVMLGSDESMVPYNQREFAPVVRGIARTQARIEVRQNGYLIDSRTVAPGAFALTDLPLTGSGGDLQVTVQESDGTAQVLTVPYTTPAIALREGYMKYSIAGGEYRSSDDAVEHSPLGQMSVMYGLPWGLTAFGGAQMSSHYQSAALGLGWSMGRLGAVSVDGIHSRGQQKGRDTETGETWRLRYNKSFELTNTDLTAARYQYTSSGFHTLSDVLSTFRNDNFRAYSYSGDRSRRTTLRLNQSLGSLGYMSLYGSRDEFRHNRQKQDSFGMSYGTSWKNISWYVNWSRNYSTNAYYQRGHIEDSINLWMNIPLGQWIGGRDNDINVTTQTQRTTGQNTWYETGLNGRAFDRRLYWDVSERIAPGSENNVDSSRLNLRWFGTYGELAGMYSYSSHIRQMSAGISGGMVLHNEGITLGQKGEDTVALVVAPGVNGASVGSLPGVRTDTRGYTLVNHVSPYQENLITLDPTTFPENVEVSQTDTRVVPTKGAVVRAKFITRVGGRALITLSRSDGSRLPFGAVVTEEGKKGQMPGGAGVVGDNGEVYLSGLDETGQLKVQWGRNSSCRANYRLPEEKEATGIFLVRTVCM

SEQ ID NO: 17512 - protein, 255 aa, Escherichia coli MS 84-1; identical to SEQ ID NO: 16256

SEQ ID NO: 17513 - protein, 236 aa, Escherichia coli MS 84-1; identical to SEQ ID NO: 16227

SEQ ID NO: 17514 - protein, 851 aa, Escherichia coli MS 84-1; identical to SEQ ID NO: 13000

SEQ ID NO: 17515 - protein, 233 aa, Escherichia coli MS 84-1; identical to SEQ ID NO: 6327

SEQ ID NO: 17516 - protein, 146 aa, Escherichia coli MS 84-1; identical to SEQ ID NO: 16230

SEQ ID NO: 17517 - protein, 204 aa, Escherichia coli MS 84-1; identical to SEQ ID NO: 5755

SEQ ID NO: 17518 - protein, 243 aa, Escherichia coli MS 84-1; identical to SEQ ID NO: 6145

SEQ ID NO: 17519 - protein, 365 aa, Escherichia coli MS 84-1; identical to SEQ ID NO: 7354

SEQ ID NO: 17520 - protein, 751 aa, Escherichia coli MS 84-1
MDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSEFSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYATLGVGYNYDRDQHDVNWQLSGGVVGHENGITLSQPFGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSIGITSMWVMTGKFI

SEQ ID NO: 17521 - protein, 230 aa, Escherichia coli MS 84-1; identical to SEQ ID NO: 6294

SEQ ID NO: 17522 - protein, 650 aa, Escherichia coli MS 84-1; identical to SEQ ID NO: 16271

SEQ ID NO: 17523 - protein, 794 aa, Escherichia coli MS 84-1; identical to SEQ ID NO: 16272

SEQ ID NO: 17524 - protein, 367 aa, Escherichia coli MS 84-1; identical to SEQ ID NO: 5784

SEQ ID NO: 17525 - protein, 219 aa, Escherichia coli MS 84-1; identical to SEQ ID NO: 6490

SEQ ID NO: 17526 - protein, 274 aa, Escherichia coli MS 84-1; identical to SEQ ID NO: 6489

SEQ ID NO: 17527 - protein, 250 aa, Escherichia coli MS 84-1; identical to SEQ ID NO: 6317

SEQ ID NO: 17528 - protein, 862 aa, Escherichia coli MS 84-1; identical to SEQ ID NO: 16254

SEQ ID NO: 17529 - protein, 224 aa, Escherichia coli MS 84-1; identical to SEQ ID NO: 15902

SEQ ID NO: 17530 - protein, 883 aa, Escherichia coli MS 84-1; identical to SEQ ID NO: 10607

SEQ ID NO: 17531 - protein, 518 aa, Escherichia coli MS 84-1; identical to SEQ ID NO: 6358

SEQ ID NO: 17532 - protein, 231 aa, Escherichia coli MS 84-1; identical to SEQ ID NO: 13029

SEQ ID NO: 17533 - protein, 771 aa, Escherichia coli MS 84-1; identical to SEQ ID NO: 16220

SEQ ID NO: 17534 - protein, 122 aa, Escherichia coli MS 84-1; identical to SEQ ID NO: 5737

SEQ ID NO: 17535 - protein, 368 aa, Escherichia coli MS 84-1; identical to SEQ ID NO: 16261

SEQ ID NO: 17536 - protein, 241 aa, Escherichia coli MS 84-1; identical to SEQ ID NO: 16262

SEQ ID NO: 17537 - protein, 856 aa, Escherichia coli MS 84-1; identical to SEQ ID NO: 16263

SEQ ID NO: 17538 - protein, 784 aa, Escherichia coli MS 84-1; identical to SEQ ID NO: 12980

SEQ ID NO: 17539 - protein, 825 aa, Escherichia coli MS 84-1
MGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLDTEQRTSGFQSIDTQMSSDFKGNNQLNVSSSGYSDNARLSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIE

SEQ ID NO: 17540 - protein, 230 aa, Escherichia coli MS 84-1; identical to SEQ ID NO: 7855

SEQ ID NO: 17541 - protein, 729 aa, Escherichia coli MS 84-1; identical to SEQ ID NO: 12984

SEQ ID NO: 17542 - protein, 733 aa, Escherichia coli MS 84-1; identical to SEQ ID NO: 15423

SEQ ID NO: 17543 - protein, 722 aa, Escherichia coli MS 84-1; identical to SEQ ID NO: 16279

SEQ ID NO: 17544 - protein, 252 aa, Escherichia coli MS 84-1; identical to SEQ ID NO: 7371

SEQ ID NO: 17545 - protein, 603 aa, Escherichia coli MS 84-1; identical to SEQ ID NO: 16223

SEQ ID NO: 17546 - protein, 686 aa, Escherichia coli MS 84-1; identical to SEQ ID NO: 6453

SEQ ID NO: 17547 - protein, 267 aa, Escherichia coli MS 84-1; identical to SEQ ID NO: 15862

SEQ ID NO: 17548 - protein, 836 aa, Escherichia coli MS 84-1; identical to SEQ ID NO: 14687

SEQ ID NO: 17549 - protein, 208 aa, Escherichia coli MS 84-1; identical to SEQ ID NO: 5717

SEQ ID NO: 17550 - protein, 446 aa, Escherichia coli MS 84-1; identical to SEQ ID NO: 6459

SEQ ID NO: 17551 - protein, 478 aa, Escherichia coli MS 84-1; identical to SEQ ID NO: 13185

SEQ ID NO: 17552 - protein, 360 aa, Escherichia coli MS 84-1; identical to SEQ ID NO: 6702

SEQ ID NO: 17553 - protein, 432 aa, Escherichia coli MS 84-1; identical to SEQ ID NO: 5727

SEQ ID NO: 17554 - protein, 207 aa, Escherichia coli MS 84-1; identical to SEQ ID NO: 13010

SEQ ID NO: 17555 - protein, 554 aa, Escherichia coli MS 84-1; identical to SEQ ID NO: 16273

SEQ ID NO: 17556 - protein, 245 aa, Escherichia coli MS 84-1; identical to SEQ ID NO: 15432

SEQ ID NO: 17557 - protein, 819 aa, Escherichia coli MS 84-1; identical to SEQ ID NO: 16267

SEQ ID NO: 17558 - protein, 431 aa, Escherichia coli MS 84-1; identical to SEQ ID NO: 6791

SEQ ID NO: 17559 - protein, 331 aa, Escherichia coli MS 84-1; identical to SEQ ID NO: 16239

SEQ ID NO: 17560 - protein, 733 aa, Escherichia coli MS 84-1; identical to SEQ ID NO: 16240

SEQ ID NO: 17561 - protein, 111 aa, Escherichia coli MS 84-1; identical to SEQ ID NO: 7885

SEQ ID NO: 17562 - protein, 386 aa, Escherichia coli MS 84-1; identical to SEQ ID NO: 7908

SEQ ID NO: 17563 - protein, 746 aa, Escherichia coli MS 84-1; identical to SEQ ID NO: 7355

SEQ ID NO: 17564 - protein, 121 aa, Escherichia coli MS 84-1; identical to SEQ ID NO: 6175

SEQ ID NO: 17565 - protein, 204 aa, Escherichia coli MS 85-1; identical to SEQ ID NO: 5755

SEQ ID NO: 17566 - protein, 146 aa, Escherichia coli MS 85-1; identical to SEQ ID NO: 16230

SEQ ID NO: 17567 - protein, 233 aa, Escherichia coli MS 85-1; identical to SEQ ID NO: 6327

SEQ ID NO: 17568 - protein, 591 aa, Escherichia coli MS 85-1; identical to SEQ ID NO: 13216

SEQ ID NO: 17569 - protein, 236 aa, Escherichia coli MS 85-1; identical to SEQ ID NO: 16227

SEQ ID NO: 17570 - protein, 245 aa, Escherichia coli MS 85-1; identical to SEQ ID NO: 15432

SEQ ID NO: 17571 - protein, 819 aa, Escherichia coli MS 85-1; identical to SEQ ID NO: 16267

SEQ ID NO: 17572 - protein, 431 aa, Escherichia coli MS 85-1; identical to SEQ ID NO: 6791

SEQ ID NO: 17573 - protein, 331 aa, Escherichia coli MS 85-1; identical to SEQ ID NO: 16239

SEQ ID NO: 17574 - protein, 733 aa, Escherichia coli MS 85-1; identical to SEQ ID NO: 16240

SEQ ID NO: 17575 - protein, 111 aa, Escherichia coli MS 85-1; identical to SEQ ID NO: 7885

SEQ ID NO: 17576 - protein, 122 aa, Escherichia coli MS 85-1; identical to SEQ ID NO: 5737

SEQ ID NO: 17577 - protein, 603 aa, Escherichia coli MS 85-1; identical to SEQ ID NO: 16223

SEQ ID NO: 17578 - protein, 252 aa, Escherichia coli MS 85-1; identical to SEQ ID NO: 7371

SEQ ID NO: 17579 - protein, 231 aa, Escherichia coli MS 85-1; identical to SEQ ID NO: 13029

SEQ ID NO: 17580 - protein, 771 aa, Escherichia coli MS 85-1; identical to SEQ ID NO: 16220

SEQ ID NO: 17581 - protein, 432 aa, Escherichia coli MS 85-1; identical to SEQ ID NO: 5727

SEQ ID NO: 17582 - protein, 360 aa, Escherichia coli MS 85-1; identical to SEQ ID NO: 6702

SEQ ID NO: 17583 - protein, 518 aa, Escherichia coli MS 85-1; identical to SEQ ID NO: 6358

SEQ ID NO: 17584 - protein, 230 aa, Escherichia coli MS 85-1; identical to SEQ ID NO: 6294

SEQ ID NO: 17585 - protein, 820 aa, Escherichia coli MS 85-1; identical to SEQ ID NO: 12991

SEQ ID NO: 17586 - protein, 650 aa, Escherichia coli MS 85-1; identical to SEQ ID NO: 16271

SEQ ID NO: 17587 - protein, 794 aa, Escherichia coli MS 85-1; identical to SEQ ID NO: 16272

SEQ ID NO: 17588 - protein, 386 aa, Escherichia coli MS 85-1; identical to SEQ ID NO: 7908

SEQ ID NO: 17589 - protein, 856 aa, Escherichia coli MS 85-1; identical to SEQ ID NO: 16263

SEQ ID NO: 17590 - protein, 241 aa, Escherichia coli MS 85-1; identical to SEQ ID NO: 16262

SEQ ID NO: 17591 - protein, 368 aa, Escherichia coli MS 85-1; identical to SEQ ID NO: 16261

SEQ ID NO: 17592 - protein, 784 aa, Escherichia coli MS 85-1; identical to SEQ ID NO: 12980

SEQ ID NO: 17593 - protein, 267 aa, Escherichia coli MS 85-1; identical to SEQ ID NO: 15862

SEQ ID NO: 17594 - protein, 836 aa, Escherichia coli MS 85-1; identical to SEQ ID NO: 14687

SEQ ID NO: 17595 - protein, 239 aa, Escherichia coli MS 85-1; identical to SEQ ID NO: 16265

SEQ ID NO: 17596 - protein, 831 aa, Escherichia coli MS 85-1; identical to SEQ ID NO: 16264

SEQ ID NO: 17597 - protein, 663 aa, Escherichia coli MS 85-1; identical to SEQ ID NO: 16280

SEQ ID NO: 17598 - protein, 367 aa, Escherichia coli MS 85-1; identical to SEQ ID NO: 5784

SEQ ID NO: 17599 - protein, 219 aa, Escherichia coli MS 85-1; identical to SEQ ID NO: 6490

SEQ ID NO: 17600 - protein, 274 aa, Escherichia coli MS 85-1; identical to SEQ ID NO: 6489

SEQ ID NO: 17601 - protein, 250 aa, Escherichia coli MS 85-1; identical to SEQ ID NO: 6317

SEQ ID NO: 17602 - protein, 862 aa, Escherichia coli MS 85-1; identical to SEQ ID NO: 16254

SEQ ID NO: 17603 - protein, 746 aa, Escherichia coli MS 85-1; identical to SEQ ID NO: 7355

SEQ ID NO: 17604 - protein, 825 aa, Escherichia coli MS 85-1; identical to SEQ ID NO: 17539

SEQ ID NO: 17605 - protein, 230 aa, Escherichia coli MS 85-1; identical to SEQ ID NO: 7855

SEQ ID NO: 17606 - protein, 729 aa, Escherichia coli MS 85-1; identical to SEQ ID NO: 12984

SEQ ID NO: 17607 - protein, 266 aa, Escherichia coli MS 85-1; identical to SEQ ID NO: 5772

SEQ ID NO: 17608 - protein, 161 aa, Escherichia coli MS 85-1; identical to SEQ ID NO: 5769

SEQ ID NO: 17609 - protein, 207 aa, Escherichia coli MS 85-1; identical to SEQ ID NO: 13010

SEQ ID NO: 17610 - protein, 554 aa, Escherichia coli MS 85-1; identical to SEQ ID NO: 16273

SEQ ID NO: 17611 - protein, 446 aa, Escherichia coli MS 85-1; identical to SEQ ID NO: 6459

SEQ ID NO: 17612 - protein, 478 aa, Escherichia coli MS 85-1; identical to SEQ ID NO: 13185

SEQ ID NO: 17613 - protein, 243 aa, Escherichia coli MS 85-1; identical to SEQ ID NO: 6145

SEQ ID NO: 17614 - protein, 208 aa, Escherichia coli MS 85-1; identical to SEQ ID NO: 5717

SEQ ID NO: 17615 - protein, 883 aa, Escherichia coli MS 85-1; identical to SEQ ID NO: 10607

SEQ ID NO: 17616 - protein, 224 aa, Escherichia coli MS 85-1; identical to SEQ ID NO: 15902

SEQ ID NO: 17617 - protein, 517 aa, Escherichia coli MS 85-1; identical to SEQ ID NO: 6817

SEQ ID NO: 17618 - protein, 191 aa, Escherichia coli MS 85-1; identical to SEQ ID NO: 5748

SEQ ID NO: 17619 - protein, 235 aa, Escherichia coli MS 85-1; identical to SEQ ID NO: 6404

SEQ ID NO: 17620 - protein, 729 aa, Escherichia coli MS 85-1; identical to SEQ ID NO: 6531

SEQ ID NO: 17621 - protein, 213 aa, Escherichia coli MS 85-1; identical to SEQ ID NO: 5744

SEQ ID NO: 17622 - protein, 353 aa, Escherichia coli MS 85-1; identical to SEQ ID NO: 15872

SEQ ID NO: 17623 - protein, 700 aa, Escherichia coli MS 85-1; identical to SEQ ID NO: 13012

SEQ ID NO: 17624 - protein, 541 aa, Escherichia coli MS 85-1; identical to SEQ ID NO: 6286

SEQ ID NO: 17625 - protein, 686 aa, Escherichia coli MS 85-1; identical to SEQ ID NO: 6453

SEQ ID NO: 17626 - protein, 836 aa, Escherichia coli MS 85-1; identical to SEQ ID NO: 17511

SEQ ID NO: 17627 - protein, 255 aa, Escherichia coli MS 85-1; identical to SEQ ID NO: 16256

SEQ ID NO: 17628 - protein, 121 aa, Escherichia coli MS 85-1; identical to SEQ ID NO: 6175

SEQ ID NO: 17629 - protein, 673 aa, Escherichia coli MS 85-1; identical to SEQ ID NO: 6170

SEQ ID NO: 17630 - protein, 722 aa, Escherichia coli MS 85-1; identical to SEQ ID NO: 16279

SEQ ID NO: 17631 - protein, 828 aa, Escherichia coli MS 85-1; identical to SEQ ID NO: 6558

SEQ ID NO: 17632 - protein, 169 aa, Escherichia coli MS 85-1; identical to SEQ ID NO: 8240

SEQ ID NO: 17633 - protein, 365 aa, Escherichia coli MS 85-1; identical to SEQ ID NO: 7354

SEQ ID NO: 17634 - protein, 244 aa, Escherichia coli MS 85-1; identical to SEQ ID NO: 6111

SEQ ID NO: 17635 - protein, 836 aa, Escherichia coli MS 85-1; identical to SEQ ID NO: 17503

SEQ ID NO: 17636 - protein, 774 aa, Escherichia coli MS 85-1; identical to SEQ ID NO: 16243

SEQ ID NO: 17637 - protein, 682 aa, Escherichia coli MS 85-1
MKNKYIIAPGIAVMCSAVISSGYASSDKKEDTLVVTASGFTQQLRNAPASVSVITSEQLQKKPVSDLVDAVKDVEGISITGGNEKPDISIRGLSGDYTLILVDGRRQSGRESRPNGSGGFEAGFIPPVEAIERIEVIRGPMSSLYGSDAIGGVINIITKPVNNQTWDGVLGLGGIIQEHGKFGNSTTNDFYLSGPLIKDKLGLQLYGGMNYRKEDSISQGTPAKDNKNITATLQFTPTESQKFVFEYGKNNQVHTLTPGESLDAWTMRGNLKQPNSKRETHNSRSHWVAAWNAQGEILHPEIAVYQEKVIREIKSGKKDKYNHWDLNYESRKPEITNTIIDAKVTAFLPENVLTIGGQFQHAELRDDSATGKKTTETQSVSIKQKAVFIENEYAATDSLALTGGLRLDDHEIYGSYWNPRLYAVYNLTDNLTLKGGIAKAFRAPSIREVSPGFGTLTQGGASIMYGNRDLKPETSVTEEIGIIYSNDSGFSASATLFNTDFKNKLTSYDIGTKDPVTGLNTFIYDNVGEANIRGVELATQIPVYDKWHVSANYTFTDSRRKSDDESLNGKSLKGEPLERTPRHAANAKLEWDYTQDITFYSSLNYTGKQIWAAQRNGAKVPRVRNGFTSMDIGLNYQILPDTLINFAVLNVTDRKSEDIDTIDGNWQVDEGRRYWANVRVSF

SEQ ID NO: 17638 - protein, 733 aa, Escherichia coli MS 85-1; identical to SEQ ID NO: 15423

SEQ ID NO: 17639 - protein, 746 aa, Escherichia coli NA114; identical to SEQ ID NO: 8287

SEQ ID NO: 17640 - protein, 118 aa, Escherichia coli NA114 [sequence omitted]

SEQ ID NO: 17641 - protein, 696 aa, Escherichia coli NA114; identical to SEQ ID NO: 6787

SEQ ID NO: 17642 - protein, 682 aa, Escherichia coli NA114; identical to SEQ ID NO: 6110

SEQ ID NO: 17643 - protein, 368 aa, Escherichia coli NA114; identical to SEQ ID NO: 8785

SEQ ID NO: 17644 - protein, 241 aa, Escherichia coli NA114; identical to SEQ ID NO: 6143

SEQ ID NO: 17645 - protein, 856 aa, Escherichia coli NA114
MAGFFVRLFVACAFAAQAPLSSAELYFNPRFLADDPQAVADLSRFENGQELPPGTYRVDIYLNNGYMATRDVTFNTGDSEQGIVPCLTRAQLASMGLNMASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCIANYQLPPESQQQLLTQLSAECR

SEQ ID NO: 17646 - protein, 193 aa, Escherichia coli NA114; identical to SEQ ID NO: 6300

SEQ ID NO: 17647 - protein, 430 aa, Escherichia coli NA114; identical to SEQ ID NO: 5758

SEQ ID NO: 17648 - protein, 331 aa, Escherichia coli NA114; identical to SEQ ID NO: 6551

SEQ ID NO: 17649 - protein, 673 aa, Escherichia coli NA114; identical to SEQ ID NO: 6170

SEQ ID NO: 17650 - protein, 715 aa, Escherichia coli NA114; identical to SEQ ID NO: 6806

SEQ ID NO: 17651 - protein, 836 aa, Escherichia coli NA114
MKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSREQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 17652 - protein, 244 aa, Escherichia coli NA114; identical to SEQ ID NO: 6219

SEQ ID NO: 17653 - protein, 714 aa, Escherichia coli NA114
MAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSDYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 17654 - protein, 760 aa, Escherichia coli NA114
MENNRNFPARQFHSLTFFAGLCIGITPVAQALAAEGQANADDTLVVEASTPSLYAPQKSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGFSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPTVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 17655 - protein, 690 aa, Escherichia coli NA114
MIVTGNTAADTTDSAAGAGFKTNDIDVGPLGTKSWIETPYSSTTVTKEMIENQQAQSVSEMLKYSPSTQMQARGGMDVGRPQSRGMQGSVVANSRLDGLNIVSTTAFPVEMLERMDVLNSLTGALYGPASPAGQFNFVAKRPTEETLRKVTLGYQSRSAFTGHADLGGHFDENKRFGYRVNLLDQEGEGNVHDSTLRRKLVSVALDWNIQPGTQLQLDASHYEFIQKGYVGSFNYGPNVKLPSAPNPKDKNLALSTAGNDLTTDTISTRLIHYFNDDWSMNAGVGWQQADRAMRSVSSKILNNQGDISRSMKDSTAAGRFRVLSNTAGLNGHIDTGSICHDLSLSTTGYVWSLYSAKGTGSSYSWGTTNMYHPDAIDEQGDGKIRTGGPRYRSSVNTQQSVTLGDTVTFTPQWSAMFYLSQSWLQTKNYDKHGNQTNQVDENGLSPNAALMYKITPNTMAYVSYADSLEQGGTAPTDESVKNAGQTLNPYRSKQYEVGLKSDIGEMNLGAALFRLERPFAYLDTDNVYKEQGNQVNNGLELTAAGNVWQGLNIYSGVTFLDPKLKDTANASTSNKQVVGVPKVQANLLAEYSLPSIPEWVYSANVHYTGKRAANDTNTSYASSYTTWDLGTRYTTKVSNVPTTFRVVVNNVFDKHYWASIFPSGTDGDNGSPSAFIGGGREVRASVTFDF

SEQ ID NO: 17656 - protein, 654 aa, Escherichia coli NA114; identical to SEQ ID NO: 8265

SEQ ID NO: 17657 - protein, 900 aa, Escherichia coli NA114
MKLNIFTKSMIGMGLVCSSLPALAMEAWNNQQGGNKYQVIFDGKIYENAWWVSSTNCPGKAKANDATNPWRLKRTATAAEISQFGNTLSCEKSGSSSSSTSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGSIYKNAWWVGAANCPGDAKENDASNPWRYVRAATATEITQYGNPGSCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIVDGFQASKAYSANSIVDYNDAHYKTSVDQDAWGFVPGGDNPWKKYEPAKAWSASTVYVKGDRVVVDGQAYEALFWTQSDNPALVANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHAQLKGLYGNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 17658 - protein, 203 aa, Escherichia coli NA114; identical to SEQ ID NO: 6414

SEQ ID NO: 17659 - protein, 386 aa, Escherichia coli NA114; identical to SEQ ID NO: 8261

SEQ ID NO: 17660 - protein, 641 aa, Escherichia coli NA114
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSASHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 17661 - protein, 162 aa, Escherichia coli NA114; identical to SEQ ID NO: 5896

SEQ ID NO: 17662 - protein, 373 aa, Escherichia coli NA114; identical to SEQ ID NO: 5781

SEQ ID NO: 17663 - protein, 660 aa, Escherichia coli NA114; identical to SEQ ID NO: 6837

SEQ ID NO: 17664 - protein, 362 aa, Escherichia coli NA114; identical to SEQ ID NO: 5808

SEQ ID NO: 17665 - protein, 200 aa, Escherichia coli NA114; identical to SEQ ID NO: 5898

SEQ ID NO: 17666 - protein, 191 aa, Escherichia coli NA114; identical to SEQ ID NO: 16539

SEQ ID NO: 17667 - protein, 232 aa, Escherichia coli NA114; identical to SEQ ID NO: 8305

SEQ ID NO: 17668 - protein, 274 aa, Escherichia coli NA114; identical to SEQ ID NO: 15658

SEQ ID NO: 17669 - protein, 250 aa, Escherichia coli NA114; identical to SEQ ID NO: 8299

SEQ ID NO: 17670 - protein, 882 aa, Escherichia coli NA114
MPNHSNFRLRGIACYIALAISGGSVNAWADDSIQFDPRFLELKGDTKIDLGKFSKKGYVDAGKYNLRVFINKQSLSDEYDINWYVSENDPTKTYACLTPELVAALGLKEGIAKSLQWTHNDECLKPGQLDGMEVENDLSQSALLLTVPQAYLEYTSSDWDPPSRWDDGISGLIADYSLNAQTRHQEQGGEDSHDISGNGTVGANLGAWRFRADWQSDYQHTRSNDDEDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADEHYQSAAMGVGRDLAQFGALAFDVTHSHVNLDHDSAYGKGKLDGNSFRVSYAKDFDELNSRVTFAGYRFSEKNFMTMSEYLDASQSDMARTGNDKEMYTITYNQNFAAAGVSVYLNYSHRTYWDRPEQTNYNLMFSHYFNMGSIRNMSISVTGYRYEYDDNTDKGMYLSMSIPWSDSSTVTYNGSYGSGSDSSQVGYFNRIDDATHYQINVGTSEQHGSVDGYLSHDGTLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGINAGEHMMVFWEGSAQCEIVLPKPLPADLFRGLLLPCEQKGTTAPDSLAPEIKPVIQDQTRQVTPSEAPTSISATQ

SEQ ID NO: 17671 - protein, 729 aa, Escherichia coli NA114
MLSTQFNRDNQHQAIIKPSLLAGCIALALLPSAAFAAPATEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDRSPQSLAQDDTTHMKSLYAATRVTLADPLHLILGARYTKWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNLSITGTYQF

SEQ ID NO: 17672 - protein, 213 aa, Escherichia coli NA114
MTKMSRYALITALAMFLAGCVGQREPAPVEEVKPAPEQPTEPQQPVPTVPSVPTIPQQPGPIEHEDQTAPPAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 17673 - protein, 774 aa, Escherichia coli NA114; identical to SEQ ID NO: 6673

SEQ ID NO: 17674 - protein, 518 aa, Escherichia coli NA114; identical to SEQ ID NO: 7565

SEQ ID NO: 17675 - protein, 208 aa, Escherichia coli NA114; identical to SEQ ID NO: 5869

SEQ ID NO: 17676 - protein, 784 aa, Escherichia coli NA114; identical to SEQ ID NO: 8272

SEQ ID NO: 17677 - protein, 203 aa, Escherichia coli NA114; identical to SEQ ID NO: 7450

SEQ ID NO: 17678 - protein, 656 aa, Escherichia coli NA114; identical to SEQ ID NO: 8311

SEQ ID NO: 17679 - protein, 565 aa, Escherichia coli NA114
MKSPAPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAIGDNAMANQYETLANARQKGIEKYLWNDQQSWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 17680 - protein, 207 aa, Escherichia coli NA114
MTLPDFRFIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 17681 - protein, 866 aa, Escherichia coli NA114
MTIKPTKNYHNHLTRIATFCALLYCNGAFCAELVEYDHTFLMGQNASNIDLSRYSEGNPAIPGVYDVSVYVNDQPVINQSITFVAIEGKKNAQACITLKNLLQFHINSPDINSEKAVLLARDEALGNCLNLTEIIPQASVRYDVNDQRLDIDVPQAWVMKNYQNYVDPSLWENGINAAMLSYNLNGYHSETPGRKNDSIYAAFNGGMNLGAWRLRASGNYNWMTDSGGNYDFKNRYIQRDIASLRSQFIIGESYTTGETFDSVSIRGIRLYSDSRMLPPTLASFAPIIHGVANTNAKVTITQGGYKIYETTVPPGAFVIDDLSPSGYGSDLIVTIEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSISAQRSWNEDGDADDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDDQGNVIGNVGQGGQAFVRGIEQQGNINIKWLEESKPVSCLAHYQQSSEAEKIAQSIILNGIRCQIQ

SEQ ID NO: 17682 - protein, 246 aa, Escherichia coli NA114
MFFNTKYTAALCFATCVAFSSSAIADIVISGTRVIYKSDQKSVNIRLENKGNNPLLVQSWLDTGDDNAEPGSITVPFTATPPVSRIDAKRGQTIKLMYTASSVLPKDRESVFWFNVLEVPPKPDAATVANQSLLQLAFRTRIKLFYRPEALKGNPSEAPLALKWSWSGSEGKAALRVANPTPYYVSFSSGDLEASGKRFPIDVKMIAPFSDEVMKVTGLNGKANSAKVHFYAINDFGGAIEGNASL

SEQ ID NO: 17683 - protein, 749 aa, Escherichia coli NA114
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKMQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGAEEQRYAIAPAFTWRPNDKTNFTFLSYFQNEPETGYYGWLPKEGTVEPLPNGKRLPTDFNEGAKNNTYSRNEKMIGYSFDHEFNDTFTVRQNLRFAQNKVSQKSVYGYGMCSDPLYSSNPSSSPCANVPQSQWGHTLTRQYVIDNEKLENFSVDTQLQSKFATGSVDHTLLTGVDFMRMRNDIDSWFGYAGSVAPSDIYNLDRSDFDFGAHPNPSGPYRVLLKQKQTGLYVQDQAQWDKVLVTLGGRYDWADQSSFNRDYGNKSERDDKEFTWRGGVNYLFDNGVTPYFSYSESFEPASQTDANGDLFAPSKGKQYEVGVKYVPEDRPIVVTGALYQLTKTNNLMADPNGSLFSVEGGEIRARGVELEAKAALSASVNLVGSYTYTDAEYTTDTNYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 17684 - protein, 505 aa, Escherichia coli NA114; identical to SEQ ID NO: 8268

SEQ ID NO: 17685 - protein, 432 aa, Escherichia coli NA114; identical to SEQ ID NO: 5727

SEQ ID NO: 17686 - protein, 614 aa, Escherichia coli NA114
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDVWSGFVRGYGYDNRTNYDAYYSPGSPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGSRYDKDYSSYPYQTVKMGGVSLWDLAVAYPVTSHLTVRGKIANLFDKDYETVYGYQTAGREYTLSGSYTF

SEQ ID NO: 17687 - protein, 266 aa, Escherichia coli NA114; identical to SEQ ID NO: 5772

SEQ ID NO: 17688 - protein, 161 aa, Escherichia coli NA114; identical to SEQ ID NO: 5769

SEQ ID NO: 17689 - protein, 539 aa, Escherichia coli NA114; identical to SEQ ID NO: 7564

SEQ ID NO: 17690 - protein, 446 aa, Escherichia coli NA114; identical to SEQ ID NO: 5873

SEQ ID NO: 17691 - protein, 237 aa, Escherichia coli NA114; identical to SEQ ID NO: 7546

SEQ ID NO: 17692 - protein, 221 aa, Escherichia coli NA114; identical to SEQ ID NO: 7446

SEQ ID NO: 17693 - protein, 351 aa, Escherichia coli NA114; identical to SEQ ID NO: 8304

SEQ ID NO: 17694 - protein, 700 aa, Escherichia coli NA114
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVATTRFTTHGYRDHSGAQKNLANAKLGVRIDDASKLSLIFNSVDIKADDPGGLTEAEWKANPQQAPRAEQYDMRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYIPEDGWYAGTEARYMGDIMADDENTAKAPSYTLVGLFTGYKYNYHNLTVDLFGRVDNLFDKEYVGSVIVNESNGRYYEPAPGRNYGVGINIAWRFE

SEQ ID NO: 17695 - protein, 871 aa, Escherichia coli NA114
MHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGHYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTQGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPAVSPGTLLNQQTAICR

SEQ ID NO: 17696 - protein, 236 aa, Escherichia coli NA114
MQTTRTPYSVSFMATVLLLFLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTHLAMAPEEAPAMLRFRRSGSILTLINPTPYFITVTNMKAGNSNLPNTMVPPKGEVSVDIPHAVTGDISFQTINDYGALTPLIKATMQ

SEQ ID NO: 17697 - protein, 111 aa, Escherichia coli NA114; identical to SEQ ID NO: 5889

SEQ ID NO: 17698 - protein, 478 aa, Escherichia coli NA114; identical to SEQ ID NO: 6796

SEQ ID NO: 17699 - protein, 359 aa, Escherichia coli NA114; identical to SEQ ID NO: 5847

SEQ ID NO: 17700 - protein, 686 aa, Escherichia coli NA114
MFWRDMTLSVWRKKTTGLKTKKRLLALVLAATLCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 17701 - protein, 711 aa, Escherichia coli NA114
MFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 17702 - protein, 840 aa, Escherichia coli NA114
MNNKNTFTGDTLSHAIKNALSGVVCSLLFVLPAHAVEFNVDMIDVEDRENIDISRFEKKGYIPPGRYLARVQINKNMLPQALILEWVKADNESGSLLCLTKEDLTSFGLNTEFIESLQTIAGRECLDLSQRQELTTRLDKATMILSLSVPQAWLKYQATNWTPPEFWDTGIAGFILDYNVYASQYAPHHGDSTQNVSSYGTLGFNLGAWRLRSDYQYNQNFADGRSVNRDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQKQNSDNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYADNARMMVDTDGISGVEINSNRTVTNGLGIAVVPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSILHLTWGDNTCEVTPPNQSNISESAIILPCKTVK

SEQ ID NO: 17703 - protein, 246 aa, Escherichia coli NA114
MKSPLITTGMICLLGICNFAQATVSPDRTRIIFNASNKSATVRLTNQSKIDPYLAQSWIEDASGKKTRGYISTLPPMERIEPDEQVQIRLMALASLNNLPQDRETLFYYNVREIPPRTKEQNVMQIAMQSRLKLFWRPKAIELKEGQMVPLQKVTITRTAAGLTLNNPTPYHITVGYIGTNGKTLMPGADSIMVTPFASATQYLNNLPSTFQLGFVADYGGLEMFKVECNSVQSLCQSSPAKKGKI

SEQ ID NO: 17704 - protein, 359 aa, Escherichia coli NC101; identical to SEQ ID NO: 5847

SEQ ID NO: 17705 - protein, 432 aa, Escherichia coli NC101; identical to SEQ ID NO: 5727

SEQ ID NO: 17706 - protein, 505 aa, Escherichia coli NC101; identical to SEQ ID NO: 14677

SEQ ID NO: 17707 - protein, 760 aa, Escherichia coli NC101
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSITDTATMRFEHDINDNATIRNTTRWSRVKQDYLMTAIMGGASNITQPTSDVNSWTWSRTANTKDVSNKILTNQTNLTSTFYTGAIGHDLSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 17708 - protein, 331 aa, Escherichia coli NC101; identical to SEQ ID NO: 16505

SEQ ID NO: 17709 - protein, 430 aa, Escherichia coli NC101; identical to SEQ ID NO: 5758

SEQ ID NO: 17710 - protein, 193 aa, Escherichia coli NC101
MRYLATLLLSLAVLITAGCSWHLRDTTQVPSTMKVMILDSGDPNGPLSRAVRNQLRLNGVELLDKETTRKDVPSLRLGKVSIAKDTASVFRNGQTAEYQMIMTVNATVLIPGRDIYPISAKVFRSFFDNPQMALAKDNEQDMIVKEMYDRAAEQLIRKLPSIRAADIRSDEEQTSTTTDTPATPARVSTTLGN

SEQ ID NO: 17711 - protein, 749 aa, Escherichia coli NC101; identical to SEQ ID NO: 5867

SEQ ID NO: 17712 - protein, 351 aa, Escherichia coli NC101
MKKSTLALVVMGIVASVSVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMMPISGGFANKTQNFEAVAQYQFDFGLRPSLGYVLSKGKDIEGIDDEDLVNYVDVGATYYFNKNMSAFVDYKINQLDSDNKLNINNDDIVAVGMTYQF

SEQ ID NO: 17713 - protein, 221 aa, Escherichia coli NC101; identical to SEQ ID NO: 7446

SEQ ID NO: 17714 - protein, 725 aa, Escherichia coli NC101
MRINKILWSLTVLLVGLNSQISVAKYSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSEEGATRRANFSLSGPLAGDALTTRLYGNLNKTDADSWDINSPVGTKNAAGHEGVRNKDINGVISWKLNPQQILDFEAGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDRDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPKDITSGGCYLIGNKDLDPEISVNKEIGLEFTWEDYHASVTYFRNDYQNKIVAGDNVIGQTASGAYILKWQNGGKALVDGIEASMSFPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 17715 - protein, 876 aa, Escherichia coli NC101
MFFGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVSLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRHDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLEDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTVSCR

SEQ ID NO: 17716 - protein, 231 aa, Escherichia coli NC101; identical to SEQ ID NO: 6154

SEQ ID NO: 17717 - protein, 362 aa, Escherichia coli NC101; identical to SEQ ID NO: 5874

SEQ ID NO: 17718 - protein, 203 aa, Escherichia coli NC101; identical to SEQ ID NO: 6414

SEQ ID NO: 17719 - protein, 111 aa, Escherichia coli NC101; identical to SEQ ID NO: 5889

SEQ ID NO: 17720 - protein, 239 aa, Escherichia coli NC101
MHQMQTTRTPYSVSFMATVLLLLLFACHSTIANAAVALGATRVIYLANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTHLAMAPEEAPAMLRFRRSGSKLTLINPTPYFITVTNMKAGNSNLPNTMVPPKGEVSVDIPHAVTGDISFQTINDYGALTPRIKATMQ

SEQ ID NO: 17721 - protein, 883 aa, Escherichia coli NC101
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTQGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAKIGGKVLMTLKYGNKSVPFGAIVTHGENKNGSIVAENGQVYLTGLPQSGKLQVSWGNDKNSNCIVDYKLPVVSPGTLLNQQTAICR

SEQ ID NO: 17722 - protein, 700 aa, Escherichia coli NC101; identical to SEQ ID NO: 5886

SEQ ID NO: 17723 - protein, 539 aa, Escherichia coli NC101
MAAVCGTSGIASLFSQAAFAADSDIADGQTQRFDFSILQSMTHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKNQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 17724 - protein, 614 aa, Escherichia coli NC101; identical to SEQ ID NO: 5872

SEQ ID NO: 17725 - protein, 208 aa, Escherichia coli NC101; identical to SEQ ID NO: 5869

SEQ ID NO: 17726 - protein, 207 aa, Escherichia coli NC101; identical to SEQ ID NO: 5882

SEQ ID NO: 17727 - protein, 565 aa, Escherichia coli NC101; identical to SEQ ID NO: 5881

SEQ ID NO: 17728 - protein, 656 aa, Escherichia coli NC101; identical to SEQ ID NO: 8223

SEQ ID NO: 17729 - protein, 203 aa, Escherichia coli NC101; identical to SEQ ID NO: 7450

SEQ ID NO: 17730 - protein, 360 aa, Escherichia coli NC101; identical to SEQ ID NO: 5879

SEQ ID NO: 17731 - protein, 213 aa, Escherichia coli NC101; identical to SEQ ID NO: 5744

SEQ ID NO: 17732 - protein, 729 aa, Escherichia coli NC101
MLSTQFNRDNQHQAIIKPSLLAGCIALALLPSAAFAAPATEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 17733 - protein, 232 aa, Escherichia coli NC101
MQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVSSTQVADARIEYVGNGYINEAQNMGWLQRFFLNLSPM

SEQ ID NO: 17734 - protein, 191 aa, Escherichia coli NC101; identical to SEQ ID NO: 5748

SEQ ID NO: 17735 - protein, 517 aa, Escherichia coli NC101; identical to SEQ ID NO: 6817

SEQ ID NO: 17736 - protein, 360 aa, Escherichia coli NC101; identical to SEQ ID NO: 5891

SEQ ID NO: 17737 - protein, 118 aa, Escherichia coli NC101 [sequence omitted]

SEQ ID NO: 17738 - protein, 673 aa, Escherichia coli NC101; identical to SEQ ID NO: 6170

SEQ ID NO: 17739 - protein, 518 aa, Escherichia coli NC101
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTIAPGHVVVNDLQTLKDTKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEVAMQLAQDYPAVSPTELGKEKFPFLSFLSQSSSNYLTHTPSLLFSRKGSEEKQN

SEQ ID NO: 17740 - protein, 882 aa, Escherichia coli NC101
MPNHSNFRLRGIACYIALAISGGSVNAWADDSIQFDPRFLELKGDTKIDLGKFSKKGYVDAGKYNLRVFINKHPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKHWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 17741 - protein, 250 aa, Escherichia coli NC101; identical to SEQ ID NO: 14717

SEQ ID NO: 17742 - protein, 274 aa, Escherichia coli NC101; identical to SEQ ID NO: 14653

SEQ ID NO: 17743 - protein, 200 aa, Escherichia coli NC101; identical to SEQ ID NO: 5898

SEQ ID NO: 17744 - protein, 376 aa, Escherichia coli NC101; identical to SEQ ID NO: 16523

SEQ ID NO: 17745 - protein, 162 aa, Escherichia coli NC101
MKTILPAVLFAAFVTTSAWAAESVQPLEKIAPYPQAEKGMKRQVIQLTPQEDESTLKVELLIGQTLEVDCNLHRLGGKLESKTLEGWGYDYYVFDKVSSPVSTMMACPDGKKEKKFVTAYLGDAGMLRYNSKLPIVVYTPDNVDVKYRVWKAEEKIDNAVVR

SEQ ID NO: 17746 - protein, 828 aa, Escherichia coli NC101
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGSNMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPLSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 17747 - protein, 663 aa, Escherichia coli NC101; identical to SEQ ID NO: 5894

SEQ ID NO: 17748 - protein, 224 aa, Escherichia coli NC101; identical to SEQ ID NO: 5893

SEQ ID NO: 17749 - protein, 826 aa, Escherichia coli NC101
MLRMTPLASAIVALLIGIEAYAAEETFDTHFMIGGMKDQQVSNIRLEDNQPLPGQYDIDIYVNKQWRGKYEIIVKDNPQETCLSREMIKRLGINTDSFASGKQCLTFKQLIQGGSYTWDIGVFRLDFSVPQAWVEELESGYVPPENWERGINAFYTSYYMSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQVGHQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 17750 - protein, 266 aa, Escherichia coli NC101; identical to SEQ ID NO: 5772

SEQ ID NO: 17751 - protein, 752 aa, Escherichia coli NC101; identical to SEQ ID NO: 8199

SEQ ID NO: 17752 - protein, 246 aa, Escherichia coli NC101; identical to SEQ ID NO: 5857

SEQ ID NO: 17753 - protein, 862 aa, Escherichia coli NC101
MTIKSTNHLTHIATFCALLYSNSALCAELVEYDHTFLMGKDASNIDLSRYTEGNPTLPGIYDVSVYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIAQEGNIRITWIEEGKPVSCFAHYQQNTTSEKIAQSIILNGLRCQIQ

SEQ ID NO: 17754 - protein, 170 aa, Escherichia coli NC101; identical to SEQ ID NO: 5855

SEQ ID NO: 17755 - protein, 784 aa, Escherichia coli NC101; identical to SEQ ID NO: 8272

SEQ ID NO: 17756 - protein, 878 aa, Escherichia coli NC101
MSYLNLRLYQRNTQCLHIRKHRLAGFFVRLFVACAFTAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGTLGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 17757 - protein, 241 aa, Escherichia coli NC101; identical to SEQ ID NO: 6140

SEQ ID NO: 17758 - protein, 368 aa, Escherichia coli NC101; identical to SEQ ID NO: 7561

SEQ ID NO: 17759 - protein, 478 aa, Escherichia coli NC101; identical to SEQ ID NO: 6796

SEQ ID NO: 17760 - protein, 237 aa, Escherichia coli NC101; identical to SEQ ID NO: 7546

SEQ ID NO: 17761 - protein, 446 aa, Escherichia coli NC101; identical to SEQ ID NO: 5873

SEQ ID NO: 17762 - protein, 660 aa, Escherichia coli NC101; identical to SEQ ID NO: 6837

SEQ ID NO: 17763 - protein, 259 aa, Escherichia coli NC101; identical to SEQ ID NO: 6832

SEQ ID NO: 17764 - protein, 229 aa, Escherichia coli NC101
MIGGTRFAYPENQSSISVELKNTSNRDMLVKVAVSPDDARQLTGTVESLPSYSETVFIATPPLFVLKPDKNTKIRINRVGGSLPTDRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDIYNNVLPILKVKLNPSQLDVTGFAFSQ

SEQ ID NO: 17765 - protein, 386 aa, Escherichia coli NC101; identical to SEQ ID NO: 5860

SEQ ID NO: 17766 - protein, 900 aa, Escherichia coli NC101
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSTSNTPASNTPANGGSATPAQGTVPSNSSVVAWNKQQGGQTWYVVFNGAIYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPASCSVKPDNNGGAVTPVDPTPETPETPVTPTLDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSANSIVDYNDAHYKTSVDQDAWSFVPGGDNPWKKYEPAKAWSASTVYVKGDRVVVDGQAYEALFWTQSDNPALIANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHAQLKGLFGNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 17767 - protein, 654 aa, Escherichia coli NC101
MDSAMKGLNKITCCLLAALLMPCAGHAENEQYGANFNNADIRQFVEIVGQHLGKTILIDPSVQGTISVRSNDTFSQQEYYHFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNSRKPSSTSAMDNVAITADEQTNSLVITADQSVQEKLATVIARLDIRRAQVLVEAIIVEVQDGNGLNLGVQWANKNVGAQQFTNTGLPVFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQLRIDGKSKALVGSEDLPVLNENTFNSHAPAPSSR

SEQ ID NO: 17768 - protein, 686 aa, Escherichia coli NC101
MFWRDMTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGSVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 17769 - protein, 678 aa, Escherichia coli NC101
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSELTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRETTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 17770 - protein, 249 aa, Escherichia coli NC101
MNIMKSPLITTGMICLLGICNFAQATVSPDRTRIIFNASNKSATVRLTNQSKIDPYLAQSWIEDASGKKTRDYISTLPPMERIEPDEQIQIRLMALASLNDLPQDRETLFYYNVREIPPRAKEQNVMQIAMQSRLKLFWRPKAIELKEGEMIPLQKVTITRTAAGLTLNNPTPYHITVGYIGTNGKTLMPGADSIMVAPFTSATQHLSSLPSTFQLGFVADYGGLEMFKVECNSIQSLCQSSPAKKGKI

SEQ ID NO: 17771 - protein, 840 aa, Escherichia coli NC101
MNNKNTFSRDKLSHAIKNALSGVVCSLLFVLPVHAVEFNVDMIDAEDRENIDISRFEKKGYIPPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDTGITGFILDYNVYASQYAPHHGDSTQNVSSYGTLGFNLGAWRLRSDYQYNQNFADGRSVNRDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSGNLRGYSYRFNYAKHFESTGSQITFAGYRFSDKDYVSMSEYLSSRNGDESIDNEKESYVISLNQYFETLELNSYLNVTRNTYWDSTSNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGIEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSTLHLTWGDNTCEVTPPNQSNISESAIILPCKTVK

SEQ ID NO: 17772 - protein, 222 aa, Escherichia coli NC101; identical to SEQ ID NO: 5850

SEQ ID NO: 17773 - protein, 713 aa, Escherichia coli NC101
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 17774 - protein, 240 aa, Escherichia coli NU14; identical to SEQ ID NO: 5818

SEQ ID NO: 17775 - protein, 784 aa, Escherichia coli O1:K1 / APEC; identical to SEQ ID NO: 6829

SEQ ID NO: 17776 - protein, 170 aa, Escherichia coli O1:K1 / APEC; identical to SEQ ID NO: 5855

SEQ ID NO: 17777 - protein, 862 aa, Escherichia coli O1:K1 / APEC
MTIKSTNHLTHIATFCALLYSNSALCAELVEYDHTFLMGKDASNIDLSRYTEGNPTLPGIYDVSVYVNDQPIMSQSIAFAVIEGKKNAQACITQKNLLQFHISSPDKNSEKAILLKRDDDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWITNVHSDYDFQNRYLQRDLASLRSQLVIGESYTTGETFDSVRIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNTTSEKIAQSIILNGLRCQIQ

SEQ ID NO: 17778 - protein, 246 aa, Escherichia coli O1:K1 / APEC; identical to SEQ ID NO: 5857

SEQ ID NO: 17779 - protein, 747 aa, Escherichia coli O1:K1 / APEC; identical to SEQ ID NO: 7499

SEQ ID NO: 17780 - protein, 266 aa, Escherichia coli O1:K1 / APEC; identical to SEQ ID NO: 7500

SEQ ID NO: 17781 - protein, 810 aa, Escherichia coli O1:K1 / APEC
MAMKKLLIASLLFSSATVYGAEGFVVKDIHFEGLQRVAVGAALLSMPVRTGDTVNDEDISNTIRALFATGNFEDVRVLRDGDTLLVQVKERPTIASITFSGNKSVKDDMLKQNLEASGVRVGESLDRTTIADIEKGLEDFYYSVGKYSASVKAVVTPLPRNRVDLKLVFQEGVSAEIQQINIVGNHAFTTDELISHFQLRDEVPWWNVVGDRKYQKQKLAGDLETLRSYYLDRGYARFNIDSTQVSLTPDKKGIYVTVNITEGDQYKLSGVEVSGNLAGHSAEIEQLTKIEPGELYNGTKVTKMEDDIKKLLGRYGYAYPRVQSMPEINDADKTVKLRVNVDAGNRFYVRKIRFEGNDTSKDAVLRREMRQMEGAWLGSDLVDQGKERLNRLGFFETVDTDTQRVPGSPDQVDVVYKVKERNTGSFNFGIGYGTESGVSFQAGVQQDNWLGTGYAVGINGTKNDYQTYAELSVTNPYFTVDGVSLGGRLFYNDFQADDADLSDYTNKSYGTDVTLGFPINEYNSLRAGLGYVHNSLSNMQPQVAMWRYLYSMGEHPSTSDQDNSFKTDDFTFNYGWTYNKLDRGYFPTDGSRVNLTGKVTIPGSDNEYYKVTLDTATYVPIDDDHKWVVLGRTRWGYGDGLGGKEMPFYENFYAGGSSTVRGFQSNTIGPKAVYFPHQARNYDPDYDYECATQDGAKDLCKSDDAVGGNAMAVASLEFITPTPFISDKYANSVRTSFFWDMGTVWDTNWDSSQYSGYPDYSDPSNIRMSAGIALQWMSPLGPLVFSYAQPFKKYDGDKAEQFQFNIGKTW

SEQ ID NO: 17782 - protein, 161 aa, Escherichia coli O1:K1 / APEC; identical to SEQ ID NO: 5769

SEQ ID NO: 17783 - protein, 353 aa, Escherichia coli O1:K1 / APEC; identical to SEQ ID NO: 7654

SEQ ID NO: 17784 - protein, 668 aa, Escherichia coli O1:K1 / APEC; identical to SEQ ID NO: 15021

SEQ ID NO: 17785 - protein, 193 aa, Escherichia coli O1:K1 / APEC; identical to SEQ ID NO: 6300

SEQ ID NO: 17786 - protein, 431 aa, Escherichia coli O1:K1 / APEC; identical to SEQ ID NO: 6791

SEQ ID NO: 17787 - protein, 332 aa, Escherichia coli O1:K1 / APEC; identical to SEQ ID NO: 5870

SEQ ID NO: 17788 - protein, 760 aa, Escherichia coli O1:K1 / APEC
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPSGLTRNGANANGQTDTFAIYAFDTLQITRDFELNGGIRLDNYHTEYDSATACGGSGRGAITCPAGVAKGSPVTTVDTAKSGNLVNWKAGALYHLTENGNIYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 17789 - protein, 512 aa, Escherichia coli O1:K1 / APEC; identical to SEQ ID NO: 7647

SEQ ID NO: 17790 - protein, 204 aa, Escherichia coli O1:K1 / APEC; identical to SEQ ID NO: 5755

SEQ ID NO: 17791 - protein, 362 aa, Escherichia coli O1:K1 / APEC; identical to SEQ ID NO: 5874

SEQ ID NO: 17792 - protein, 375 aa, Escherichia coli O1:K1 / APEC; identical to SEQ ID NO: 7644

SEQ ID NO: 17793 - protein, 423 aa, Escherichia coli O1:K1 / APEC
MQYEDENGVNEPSRRRLLKGIGALALAGSCPVAHAQKTQSAPGTLSPDARNEKQPFYGEHQAGILTPQQAAMMLVAFDVLASDKADLERLFRLLTQRFAFLTQGGAAPETPNPRLPPLDSGILGGYIAPDNLTITLSVGHSLFDERFGLAPQMPKKLQKMTRFPNDSLDAALCHGDVLLQICANTQDTVIHALRDIIKHTPDLLSVRWKREGFISDHAARSKGKETPINLLGFKDGTANPDSQNDKLMQKVVWVTADQQEPAWTIGGSYQAVRLIQFRVEFWDRTPLKEQQTIFGRDKQTGAPLGMLHEHDVPDYASDPEGKVIALDSHIRLANPRTAESESSLMLRRGYSYSLGVTNSGQLDMGLLFVCYQHDLEKGFLTVQKRLNGEALEEYVKPIGGGYFFALSGVKDANDYLGSALLRV

SEQ ID NO: 17794 - protein, 110 aa, Escherichia coli O1:K1 / APEC
MNALLLLAALSSQITFNTTQQGDMYTIIPEVTLTQSCLCRVQILSLREGSSGQSQTKQEKTLSLPANQPIALTKLSLNISPDDRVKIVVTVSDGQSLHLSQQWPPSSEKS

SEQ ID NO: 17795 - protein, 517 aa, Escherichia coli O1:K1 / APEC; identical to SEQ ID NO: 6817

SEQ ID NO: 17796 - protein, 191 aa, Escherichia coli O1:K1 / APEC; identical to SEQ ID NO: 5748

SEQ ID NO: 17797 - protein, 235 aa, Escherichia coli O1:K1 / APEC; identical to SEQ ID NO: 6404

SEQ ID NO: 17798 - protein, 366 aa, Escherichia coli O1:K1 / APEC
MVIKFLSALILLLVTTAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINLRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 17799 - protein, 729 aa, Escherichia coli O1:K1 / APEC; identical to SEQ ID NO: 6821

SEQ ID NO: 17800 - protein, 213 aa, Escherichia coli O1:K1 / APEC; identical to SEQ ID NO: 5744

SEQ ID NO: 17801 - protein, 380 aa, Escherichia coli O1:K1 / APEC; identical to SEQ ID NO: 7505

SEQ ID NO: 17802 - protein, 203 aa, Escherichia coli O1:K1 / APEC; identical to SEQ ID NO: 7450

SEQ ID NO: 17803 - protein, 656 aa, Escherichia coli O1:K1 / APEC
MRLKKRYLCTVLTLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRSIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 17804 - protein, 565 aa, Escherichia coli O1:K1 / APEC
MKSPAPSRPQKMALIPACIFLCFAALSVQAEETSVTPQPPDILLGPLFNDVQNAKLFPDQKTFADAVPNSDPLMILADYRIQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDNYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAIGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPLKQKEAEPTP

SEQ ID NO: 17805 - protein, 229 aa, Escherichia coli O1:K1 / APEC; identical to SEQ ID NO: 7628

SEQ ID NO: 17806 - protein, 551 aa, Escherichia coli O1:K1 / APEC; identical to SEQ ID NO: 5885

SEQ ID NO: 17807 - protein, 700 aa, Escherichia coli O1:K1 / APEC; identical to SEQ ID NO: 7559

SEQ ID NO: 17808 - protein, 883 aa, Escherichia coli O1:K1 / APEC; identical to SEQ ID NO: 15025

SEQ ID NO: 17809 - protein, 239 aa, Escherichia coli O1:K1 / APEC; identical to SEQ ID NO: 5888

SEQ ID NO: 17810 - protein, 111 aa, Escherichia coli O1:K1 / APEC; identical to SEQ ID NO: 5889

SEQ ID NO: 17811 - protein, 122 aa, Escherichia coli O1:K1 / APEC; identical to SEQ ID NO: 5737

SEQ ID NO: 17812 - protein, 360 aa, Escherichia coli O1:K1 / APEC; identical to SEQ ID NO: 5891

SEQ ID NO: 17813 - protein, 334 aa, Escherichia coli O1:K1 / APEC; identical to SEQ ID NO: 7534

SEQ ID NO: 17814 - protein, 673 aa, Escherichia coli O1:K1 / APEC; identical to SEQ ID NO: 8416

SEQ ID NO: 17815 - protein, 826 aa, Escherichia coli O1:K1 / APEC; identical to SEQ ID NO: 7523

SEQ ID NO: 17816 - protein, 224 aa, Escherichia coli O1:K1 / APEC; identical to SEQ ID NO: 5893

SEQ ID NO: 17817 - protein, 690 aa, Escherichia coli O1:K1 / APEC; identical to SEQ ID NO: 7614

SEQ ID NO: 17818 - protein, 828 aa, Escherichia coli O1:K1 / APEC; identical to SEQ ID NO: 7510

SEQ ID NO: 17819 - protein, 363 aa, Escherichia coli O1:K1 / APEC; identical to SEQ ID NO: 7508

SEQ ID NO: 17820 - protein, 200 aa, Escherichia coli O1:K1 / APEC; identical to SEQ ID NO: 5898

SEQ ID NO: 17821 - protein, 274 aa, Escherichia coli O1:K1 / APEC; identical to SEQ ID NO: 5899

SEQ ID NO: 17822 - protein, 250 aa, Escherichia coli O1:K1 / APEC; identical to SEQ ID NO: 7503

SEQ ID NO: 17823 - protein, 884 aa, Escherichia coli O1:K1 / APEC; identical to SEQ ID NO: 7607

SEQ ID NO: 17824 - protein, 518 aa, Escherichia coli O1:K1 / APEC; identical to SEQ ID NO: 7565

SEQ ID NO: 17825 - protein, 432 aa, Escherichia coli O1:K1 / APEC; identical to SEQ ID NO: 5727

SEQ ID NO: 17826 - protein, 359 aa, Escherichia coli O1:K1 / APEC; identical to SEQ ID NO: 5847

SEQ ID NO: 17827 - protein, 244 aa, Escherichia coli O1:K1 / APEC; identical to SEQ ID NO: 6111

SEQ ID NO: 17828 - protein, 682 aa, Escherichia coli O1:K1 / APEC; identical to SEQ ID NO: 6110

SEQ ID NO: 17829 - protein, 686 aa, Escherichia coli O1:K1 / APEC
MFWRDMTLSIWRKKTTGLKTKKRLLPLMLAAALCSSPVWEEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPVIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 17830 - protein, 713 aa, Escherichia coli O1:K1 / APEC; identical to SEQ ID NO: 6056

SEQ ID NO: 17831 - protein, 222 aa, Escherichia coli O1:K1 / APEC; identical to SEQ ID NO: 7531

SEQ ID NO: 17832 - protein, 840 aa, Escherichia coli O1:K1 / APEC; identical to SEQ ID NO: 7530

SEQ ID NO: 17833 - protein, 249 aa, Escherichia coli O1:K1 / APEC; identical to SEQ ID NO: 7529

SEQ ID NO: 17834 - protein, 678 aa, Escherichia coli O1:K1 / APEC; identical to SEQ ID NO: 7525

SEQ ID NO: 17835 - protein, 331 aa, Escherichia coli O1:K1 / APEC
MELLCPAGNLPALKAAIENGADAVYIGLKDDTNARHFAGLNFTEKKLQEAVSFVHQHRRKLHIAINTFAHPDGYARWQRAVDMAAQLGADALILADLAMLEYAAERYPHIERHVSVQASATNEEAINFYHRHFDVARVVLPRVLSIHQVKQLARVTPVPLEVFAFGSLCIMSEGRCYLSSYLTGESPNTVGACSPARFVRWQQTPQGLESRLNEVLIDRYQDGENAGYPTLCKGRYLVNGERYHALEEPTSLNTLELLPELMAANIASVKIEGRQRSPAYVSQVAKVWRQAIDRCKADPQNFIPQSAWMETLGSMSEGTQTTLGAYHRKWQ

SEQ ID NO: 17836 - protein, 654 aa, Escherichia coli O1:K1 / APEC; identical to SEQ ID NO: 6816

SEQ ID NO: 17837 - protein, 885 aa, Escherichia coli O1:K1 / APEC
MCSALPALAMEAWNNQQGGNKYQVIFDGKIYENAWWVSSTNCPGKAKANDATNPWRLKRTATAAEISQFGNTLSCEKSGSSSSSTSNTPASNTPANGASATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGGIYKNAWWVGAANCPGDAKENDASNPWRYVRAATATEITQYGNPASCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSANSIVDYNDAHYKTSVDQDAWGFVPGGDNPWKKYEPAKAWSASTVYVKGDRVVVDGQAYEALFWTQSDNPALIANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKSHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHSQLKGLHPNKSDAEIDAMMGTTPMVGVNDVQGEVFYLSDARLVMQDAQKRNLGMVGIWSIARDLPGGTNLSPEFHGLTKEQAPKYAFSEIFAPFTKQ

SEQ ID NO: 17838 - protein, 412 aa, Escherichia coli O1:K1 / APEC; identical to SEQ ID NO: 7596

SEQ ID NO: 17839 - protein, 259 aa, Escherichia coli O1:K1 / APEC; identical to SEQ ID NO: 6832

SEQ ID NO: 17840 - protein, 438 aa, Escherichia coli O1:K1 / APEC
MKPLRYTASALALGLALMANAQAVTTIPFWHSMEGELGKEVDSLAQRFNAENPDYKIVPTYKGNYEQNLSAGIAAFRTGNAPAILQVYEVGTATMMASKAIKPVYDVFKEAGIQFDESQFVPTVSGYYSDSKTGHLLSQPFNSSTPVLYYNKDAFKKAGLDPKQPPKTWQDLADYAAKLKASGMKCGYASGWQGWIQLENFSAWNGLPFASKNNGFDGTDAVLEFNKPEQVKHIAMLEEMNKKGDFSYVGRKDESTEKFYNGDCAMTTASSGSLANIREYAKFNYGVGMMPYDADAKDAPQNAIIGGASLWVMQGKDKETYTGVAKFLDFLAKPENAAEWHQKTGYLPITKAAYDLTREQGFYEKNPGADIATRQMLNKPPLPFTKGLRLGNMPQIRVIVDEELESVWTGKKTPQQALDTAVERGNQLLRRFEKSTKS

SEQ ID NO: 17841 - protein, 660 aa, Escherichia coli O1:K1 / APEC; identical to SEQ ID NO: 6109

SEQ ID NO: 17842 - protein, 538 aa, Escherichia coli O1:K1 / APEC; identical to SEQ ID NO: 7591

SEQ ID NO: 17843 - protein, 208 aa, Escherichia coli O1:K1 / APEC; identical to SEQ ID NO: 5869

SEQ ID NO: 17844 - protein, 614 aa, Escherichia coli O1:K1 / APEC; identical to SEQ ID NO: 7540

SEQ ID NO: 17845 - protein, 446 aa, Escherichia coli O1:K1 / APEC; identical to SEQ ID NO: 5873

SEQ ID NO: 17846 - protein, 260 aa, Escherichia coli O1:K1 / APEC; identical to SEQ ID NO: 6790

SEQ ID NO: 17847 - protein, 478 aa, Escherichia coli O1:K1 / APEC; identical to SEQ ID NO: 6796

SEQ ID NO: 17848 - protein, 368 aa, Escherichia coli O1:K1 / APEC; identical to SEQ ID NO: 7561

SEQ ID NO: 17849 - protein, 241 aa, Escherichia coli O1:K1 / APEC; identical to SEQ ID NO: 6139

SEQ ID NO: 17850 - protein, 878 aa, Escherichia coli O1:K1 / APEC; identical to SEQ ID NO: 7563

SEQ ID NO: 17851 - protein, 733 aa, Escherichia coli O1:K1 / APEC; identical to SEQ ID NO: 5674

SEQ ID NO: 17852 - protein, 725 aa, Escherichia coli O1:K1 / APEC; identical to SEQ ID NO: 6197

SEQ ID NO: 17853 - protein, 121 aa, Escherichia coli O1:K1 / APEC; identical to SEQ ID NO: 6175

SEQ ID NO: 17854 - protein, 512 aa, Escherichia coli O103:H2; identical to SEQ ID NO: 6251
  strain 12009 / EHEC

SEQ ID NO: 17855 - protein, 834 aa, Escherichia coli O103:H2; identical to SEQ ID NO: 8715
  strain 12009 / EHEC

SEQ ID NO: 17856 - protein, 231 aa, Escherichia coli O103:H2; identical to SEQ ID NO: 8991
  strain 12009 / EHEC

SEQ ID NO: 17857 - protein, 231 aa, Escherichia coli O103:H2; identical to SEQ ID NO: 6351
  strain 12009 / EHEC

SEQ ID NO: 17858 - protein, 838 aa, Escherichia coli O103:H2; identical to SEQ ID NO: 9266
  strain 12009 / EHEC

SEQ ID NO: 17859 - protein, 662 aa, Escherichia coli O103:H2; identical to SEQ ID NO: 8481
  strain 12009 / EHEC

SEQ ID NO: 17860 - protein, 412 aa, Escherichia coli O103:H2; identical to SEQ ID NO: 6495
  strain 12009 / EHEC

SEQ ID NO: 17861 - protein, 208 aa, Escherichia coli O103:H2; identical to SEQ ID NO: 5717
  strain 12009 / EHEC

SEQ ID NO: 17862 - protein, 228 aa, Escherichia coli O103:H2
  strain 12009 / EHEC
MKRISFAVLALLMTAQQCFAGGVALSTTRVIYDGGKKEASLTVENHNKNEEFLIQSWIDDVNSNKKTPFIITPPLFKLDPDKNNVLRIVNIEDTLPKDRESVYWINVKAIPAKSAENENKNVLQIAVRTRLKLFYRPKGLPGSNLEAMKQLRFQRQNNQIVVNNDSAYNLTFNQFSINGQKIERAGMVLAKGKLNINLPAGTGNAHEVKYSIINDFGVTGEMLTKPIN

SEQ ID NO: 17863 - protein, 843 aa, Escherichia coli O103:H2; identical to SEQ ID NO: 7909
  strain 12009 / EHEC

SEQ ID NO: 17864 - protein, 614 aa, Escherichia coli O103:H2; identical to SEQ ID NO: 7971
  strain 12009 / EHEC

SEQ ID NO: 17865 - protein, 446 aa, Escherichia coli O103:H2; identical to SEQ ID NO: 8470
  strain 12009 / EHEC

SEQ ID NO: 17866 - protein, 237 aa, Escherichia coli O103:H2; identical to SEQ ID NO: 6384
  strain 12009 / EHEC

SEQ ID NO: 17867 - protein, 478 aa, Escherichia coli O103:H2; identical to SEQ ID NO: 8471
  strain 12009 / EHEC

SEQ ID NO: 17868 - protein, 368 aa, Escherichia coli O103:H2; identical to SEQ ID NO: 7974
  strain 12009 / EHEC

SEQ ID NO: 17869 - protein, 241 aa, Escherichia coli O103:H2; identical to SEQ ID NO: 6143
  strain 12009 / EHEC

SEQ ID NO: 17870 - protein, 878 aa, Escherichia coli O103:H2
  strain 12009 / EHEC
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTTMIQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 17871 - protein, 89 aa, Escherichia coli O103:H2; identical to SEQ ID NO: 6232
  strain 12009 / EHEC

SEQ ID NO: 17872 - protein, 407 aa, Escherichia coli O103:H2
  strain 12009 / EHEC
MTERELSIIRALGEEFSTVLADLQCTFEGKMAAQAQAFEEKLASLSAVLQKHVTVDEVRPVLQAMVDDAVGGIPVPRDGRDYDPEVLQQAVNDAVAKIPVPADGKSITPDDVRPMLEQMVKEAVSHIPAPRDGRDYDPEVLKLAVNDAVAKIPVPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTADKPGDAHASGWTLAAKRGRDAGGGK

SEQ ID NO: 17873 - protein, 784 aa, Escherichia coli O103:H2; identical to SEQ ID NO: 6283
  strain 12009 / EHEC

SEQ ID NO: 17874 - protein, 170 aa, Escherichia coli O103:H2 [sequence omitted]

SEQ ID NO: 17875 - protein, 866 aa, Escherichia coli O103:H2; identical to SEQ ID NO: 8486
  strain 12009 / EHEC

SEQ ID NO: 17876 - protein, 246 aa, Escherichia coli O103:H2; identical to SEQ ID NO: 6342
  strain 12009 / EHEC

SEQ ID NO: 17877 - protein, 747 aa, Escherichia coli O103:H2; identical to SEQ ID NO: 6343
  strain 12009 / EHEC

SEQ ID NO: 17878 - protein, 266 aa, Escherichia coli O103:H2; identical to SEQ ID NO: 5772
  strain 12009 / EHEC

SEQ ID NO: 17879 - protein, 161 aa, Escherichia coli O103:H2; identical to SEQ ID NO: 5769
  strain 12009 / EHEC

SEQ ID NO: 17880 - protein, 351 aa, Escherichia coli O103:H2; identical to SEQ ID NO: 5767
  strain 12009 / EHEC

SEQ ID NO: 17881 - protein, 230 aa, Escherichia coli O103:H2; identical to SEQ ID NO: 6294
  strain 12009 / EHEC

SEQ ID NO: 17882 - protein, 820 aa, Escherichia coli O103:H2; identical to SEQ ID NO: 9222
  strain 12009 / EHEC

SEQ ID NO: 17883 - protein, 365 aa, Escherichia coli O103:H2; identical to SEQ ID NO: 7931
  strain 12009 / EHEC

SEQ ID NO: 17884 - protein, 746 aa, Escherichia coli O103:H2; identical to SEQ ID NO: 9358
  strain 12009 / EHEC

SEQ ID NO: 17885 - protein, 193 aa, Escherichia coli O103:H2; identical to SEQ ID NO: 6300
  strain 12009 / EHEC

SEQ ID NO: 17886 - protein, 243 aa, Escherichia coli O103:H2; identical to SEQ ID NO: 6463
  strain 12009 / EHEC

SEQ ID NO: 17887 - protein, 334 aa, Escherichia coli O103:H2; identical to SEQ ID NO: 6452
  strain 12009 / EHEC

SEQ ID NO: 17888 - protein, 430 aa, Escherichia coli O103:H2; identical to SEQ ID NO: 5758
  strain 12009 / EHEC

SEQ ID NO: 17889 - protein, 332 aa, Escherichia coli O103:H2; identical to SEQ ID NO: 6321
  strain 12009 / EHEC

SEQ ID NO: 17890 - protein, 760 aa, Escherichia coli O103:H2; identical to SEQ ID NO: 6455
  strain 12009 / EHEC

SEQ ID NO: 17891 - protein, 204 aa, Escherichia coli O103:H2; identical to SEQ ID NO: 5755
  strain 12009 / EHEC

SEQ ID NO: 17892 - protein, 362 aa, Escherichia coli O103:H2; identical to SEQ ID NO: 5809
  strain 12009 / EHEC

SEQ ID NO: 17893 - protein, 233 aa, Escherichia coli O103:H2; identical to SEQ ID NO: 6327
  strain 12009 / EHEC

SEQ ID NO: 17894 - protein, 407 aa, Escherichia coli O103:H2; identical to SEQ ID NO: 9304
  strain 12009 / EHEC

SEQ ID NO: 17895 - protein, 236 aa, Escherichia coli O103:H2; identical to SEQ ID NO: 6329
  strain 12009 / EHEC

SEQ ID NO: 17896 - protein, 511 aa, Escherichia coli O103:H2; identical to SEQ ID NO: 5749
  strain 12009 / EHEC

SEQ ID NO: 17897 - protein, 191 aa, Escherichia coli O103:H2
  strain 12009 / EHEC
MKKSLIGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDELDITGDLTLNGVTKPVTLEAKLIGQGDDPWGGKRAGFEAEGKIKLKDFNIKTDLGPASQEVDLIISVEGVQQK

SEQ ID NO: 17898 - protein, 232 aa, Escherichia coli O103:H2; identical to SEQ ID NO: 5747
  strain 12009 / EHEC

SEQ ID NO: 17899 - protein, 365 aa, Escherichia coli O103:H2; identical to SEQ ID NO: 6335
  strain 12009 / EHEC

SEQ ID NO: 17900 - protein, 729 aa, Escherichia coli O103:H2; identical to SEQ ID NO: 5745
  strain 12009 / EHEC

SEQ ID NO: 17901 - protein, 213 aa, Escherichia coli O103:H2; identical to SEQ ID NO: 5744
  strain 12009 / EHEC

SEQ ID NO: 17902 - protein, 826 aa, Escherichia coli O103:H2; identical to SEQ ID NO: 8499
  strain 12009 / EHEC

SEQ ID NO: 17903 - protein, 224 aa, Escherichia coli O103:H2
  strain 12009 / EHEC
MKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSDNGLVIKNDSANWVTISDVKANNVKVNYETIMIAPLESQSVNVKSNNANNWYLTIIDDHGNYISDKI

SEQ ID NO: 17904 - protein, 663 aa, Escherichia coli O103:H2
  strain 12009 / EHEC
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGQYTGQKRADSATAKTPGGYTIWNTGAAWQVTKDVKLRAGVLNLGDKDLSRDDYSYNEDGRRYFMAVDYRF

SEQ ID NO: 17905 - protein, 828 aa, Escherichia coli O103:H2; identical to SEQ ID NO: 6558
  strain 12009 / EHEC

SEQ ID NO: 17906 - protein, 162 aa, Escherichia coli O103:H2; identical to SEQ ID NO: 6365
  strain 12009 / EHEC

SEQ ID NO: 17907 - protein, 367 aa, Escherichia coli O103:H2; identical to SEQ ID NO: 5784
  strain 12009 / EHEC

SEQ ID NO: 17908 - protein, 200 aa, Escherichia coli O103:H2; identical to SEQ ID NO: 6311
  strain 12009 / EHEC

SEQ ID NO: 17909 - protein, 274 aa, Escherichia coli O103:H2; identical to SEQ ID NO: 8357
  strain 12009 / EHEC

SEQ ID NO: 17910 - protein, 250 aa, Escherichia coli O103:H2; identical to SEQ ID NO: 6317
  strain 12009 / EHEC

SEQ ID NO: 17911 - protein, 880 aa, Escherichia coli O103:H2; identical to SEQ ID NO: 6482
  strain 12009 / EHEC

SEQ ID NO: 17912 - protein, 203 aa, Escherichia coli O103:H2; identical to SEQ ID NO: 6347
  strain 12009 / EHEC

SEQ ID NO: 17913 - protein, 565 aa, Escherichia coli O103:H2; identical to SEQ ID NO: 6492
  strain 12009 / EHEC

SEQ ID NO: 17914 - protein, 207 aa, Escherichia coli O103:H2; identical to SEQ ID NO: 5743
  strain 12009 / EHEC

SEQ ID NO: 17915 - protein, 89 aa, Escherichia coli O103:H2; identical to SEQ ID NO: 6233
  strain 12009 / EHEC

SEQ ID NO: 17916 - protein, 551 aa, Escherichia coli O103:H2; identical to SEQ ID NO: 5742
  strain 12009 / EHEC

SEQ ID NO: 17917 - protein, 700 aa, Escherichia coli O103:H2; identical to SEQ ID NO: 9243
  strain 12009 / EHEC

SEQ ID NO: 17918 - protein, 883 aa, Escherichia coli O103:H2; identical to SEQ ID NO: 16336
  strain 12009 / EHEC

SEQ ID NO: 17919 - protein, 236 aa, Escherichia coli O103:H2; identical to SEQ ID NO: 7814
  strain 12009 / EHEC

SEQ ID NO: 17920 - protein, 102 aa, Escherichia coli O103:H2
  strain 12009 / EHEC
MKKVLALVVAAAMGLSSAAFAAETANTPAPTATTTKAAPAKTTHHKKQHKAAPAQKAQAAKKHHKNTKAEQKAPEQKAQAAKKHAGKHSHQQPAKPAAQPAA

SEQ ID NO: 17921 - protein, 472 aa, Escherichia coli O103:H2; identical to SEQ ID NO: 5729
  strain 12009 / EHEC

SEQ ID NO: 17922 - protein, 432 aa, Escherichia coli O103:H2; identical to SEQ ID NO: 5727
  strain 12009 / EHEC

SEQ ID NO: 17923 - protein, 359 aa, Escherichia coli O103:H2; identical to SEQ ID NO: 6332
  strain 12009 / EHEC

SEQ ID NO: 17924 - protein, 656 aa, Escherichia coli O103:H2
  strain 12009 / EHEC
MFRKWLNGRLSIFVFTTVFLSAIPGWGAEFSASFKDTDIQEFINTVSKNLHKTVIINPDVQGTITVRSYDMLNEEQYYQFFLSVLDVYGFAVVDMHNGILKVVRSKDAKTSAVPVASDASPGTGDEVVTRVVPVSNVAARDLAPLLRQLNDNAGAGSVVHYEPSNVLLMTGRAAVVKRLMEIVERVDKEGNRSVATVPLTYASATDVARLVTELTKESDKTAMPAWMTAKLVADERTNSVLVSGEPISQQRIISMIKQLDRKEDVQGNTKVIYLKYAKAKDLVEVLTGISSNIENDAKKSSSTEALRKGVTIKSHEQTNALILTGAPDVIRDLENVISQLDIRRPQVLVEAIIAEVQDADGLNLGIQWVNKHSGVTQFTSTGLPITTMVQTRQSDISDSDQSNTLSMFNGIAAGFYQGNWAMLLTALSTSSKNDILATPSIVTLDNMEATFNVGQEVPVLSGSQTTSGDNIFNTVERKTVGIKLRVKPQINEGDSVLLEIEQEVSGVADTAVATTTDLGATFNTRTVTNAMLVGNGETVVVGGLLDKSIRGSESKVPLLGDIPVLGHLFSSKSEHAAKRNLMLFIRPTIIRERDGFRHASAEKYLSFNQEQVQSRGKETMALTLNEEQLKLSRDRDDTTFRKVKTAIAAFYARGMQ

SEQ ID NO: 17925 - protein, 998 aa, Escherichia coli O103:H2; identical to SEQ ID NO: 5651
  strain 12009 / EHEC

SEQ ID NO: 17926 - protein, 784 aa, Escherichia coli O104:H4 str. 01-09591; identical to SEQ ID NO: 6283

SEQ ID NO: 17927 - protein, 170 aa, Escherichia coli O104:H4 str. 01-09591 [sequence omitted]

SEQ ID NO: 17928 - protein, 866 aa, Escherichia coli O104:H4 str. 01-09591
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTIMQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSAGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEKGNVIGNVGQGGQAFVRGIEQQGNISIKWLEESKPVSCLAHYQQSSEAEKIAQSIILNGIRCQIQ

SEQ ID NO: 17929 - protein, 246 aa, Escherichia coli O104:H4 str. 01-09591; identical to SEQ ID NO: 6342

SEQ ID NO: 17930 - protein, 747 aa, Escherichia coli O104:H4 str. 01-09591; identical to SEQ ID NO: 6343

SEQ ID NO: 17931 - protein, 266 aa, Escherichia coli O104:H4 str. 01-09591; identical to SEQ ID NO: 5772

SEQ ID NO: 17932 - protein, 161 aa, Escherichia coli O104:H4 str. 01-09591; identical to SEQ ID NO: 5769

SEQ ID NO: 17933 - protein, 351 aa, Escherichia coli O104:H4 str. 01-09591; identical to SEQ ID NO: 6282

SEQ ID NO: 17934 - protein, 230 aa, Escherichia coli O104:H4 str. 01-09591; identical to SEQ ID NO: 6294

SEQ ID NO: 17935 - protein, 869 aa, Escherichia coli O104:H4 str. 01-09591
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGLIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 17936 - protein, 746 aa, Escherichia coli O104:H4 str. 01-09591; identical to SEQ ID NO: 6296

SEQ ID NO: 17937 - protein, 193 aa, Escherichia coli O104:H4 str. 01-09591; identical to SEQ ID NO: 6300

SEQ ID NO: 17938 - protein, 760 aa, Escherichia coli O104:H4 str. 01-09591; identical to SEQ ID NO: 6322

SEQ ID NO: 17939 - protein, 243 aa, Escherichia coli O104:H4 str. 01-09591; identical to SEQ ID NO: 6463

SEQ ID NO: 17940 - protein, 816 aa, Escherichia coli O104:H4 str. 01-09591
MNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAKTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPIQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 17941 - protein, 430 aa, Escherichia coli O104:H4 str. 01-09591; identical to SEQ ID NO: 5758

SEQ ID NO: 17942 - protein, 360 aa, Escherichia coli O104:H4 str. 01-09591
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRNEVTEANGDGFGFSTTYEYEGFGVGATYAKSDRTNNQVIYGNNGLNASGQNAEVWAAGLKYDANNIYLATTYSETQNMTVFGNNHIANKAQNFEAVAQYQFDFGLRPSVAYLHSKVKDLGVWGDQDLVEYVDVGATYYFNKNMSTFVDYKINLIDKSDFTKASGVATDDIVAVGMVYQF

SEQ ID NO: 17943 - protein, 331 aa, Escherichia coli O104:H4 str. 01-09591; identical to SEQ ID NO: 6456

SEQ ID NO: 17944 - protein, 203 aa, Escherichia coli O104:H4 str. 01-09591; identical to SEQ ID NO: 6414

SEQ ID NO: 17945 - protein, 362 aa, Escherichia coli O104:H4 str. 01-09591; identical to SEQ ID NO: 5809

SEQ ID NO: 17946 - protein, 116 aa, Escherichia coli O104:H4 str. 01-09591
MYIGAPLAKDRETLFFTSVRAVPSTTKREEGNTLKIATQSVIKLFWRPKGLAYPLGEAPAKLRCTSSADMVTVSNPTPYFITLTDLKIGGKVVKNQMISPFDKYQFSLPKGAKIAA

SEQ ID NO: 17947 - protein, 161 aa, Escherichia coli O104:H4 str. 01-09591; identical to SEQ ID NO: 14956

SEQ ID NO: 17948 - protein, 729 aa, Escherichia coli O104:H4 str. 01-09591; identical to SEQ ID NO: 6336

SEQ ID NO: 17949 - protein, 213 aa, Escherichia coli O104:H4 str. 01-09591; identical to SEQ ID NO: 5744

SEQ ID NO: 17950 - protein, 511 aa, Escherichia coli O104:H4 str. 01-09591; identical to SEQ ID NO: 5749

SEQ ID NO: 17951 - protein, 191 aa, Escherichia coli O104:H4 str. 01-09591; identical to SEQ ID NO: 5748

SEQ ID NO: 17952 - protein, 232 aa, Escherichia coli O104:H4 str. 01-09591; identical to SEQ ID NO: 5747

SEQ ID NO: 17953 - protein, 203 aa, Escherichia coli O104:H4 str. 01-09591; identical to SEQ ID NO: 6347

SEQ ID NO: 17954 - protein, 565 aa, Escherichia coli O104:H4 str. 01-09591; identical to SEQ ID NO: 6395

SEQ ID NO: 17955 - protein, 207 aa, Escherichia coli O104:H4 str. 01-09591; identical to SEQ ID NO: 5743

SEQ ID NO: 17956 - protein, 700 aa, Escherichia coli O104:H4 str. 01-09591; identical to SEQ ID NO: 6287

SEQ ID NO: 17957 - protein, 753 aa, Escherichia coli O104:H4 str. 01-09591
MPDNSACTPLQDRLADASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 17958 - protein, 826 aa, Escherichia coli O104:H4 str. 01-09591; identical to SEQ ID NO: 6301

SEQ ID NO: 17959 - protein, 224 aa, Escherichia coli O104:H4 str. 01-09591; identical to SEQ ID NO: 6302

SEQ ID NO: 17960 - protein, 663 aa, Escherichia coli O104:H4 str. 01-09591; identical to SEQ ID NO: 6307

SEQ ID NO: 17961 - protein, 274 aa, Escherichia coli O104:H4 str. 01-09591; identical to SEQ ID NO: 6316

SEQ ID NO: 17962 - protein, 250 aa, Escherichia coli O104:H4 str. 01-09591; identical to SEQ ID NO: 6317

SEQ ID NO: 17963 - protein, 828 aa, Escherichia coli O104:H4 str. 01-09591; identical to SEQ ID NO: 6308

SEQ ID NO: 17964 - protein, 162 aa, Escherichia coli O104:H4 str. 01-09591; identical to SEQ ID NO: 5896

SEQ ID NO: 17965 - protein, 367 aa, Escherichia coli O104:H4 str. 01-09591; identical to SEQ ID NO: 6310

SEQ ID NO: 17966 - protein, 200 aa, Escherichia coli O104:H4 str. 01-09591; identical to SEQ ID NO: 6311

SEQ ID NO: 17967 - protein, 111 aa, Escherichia coli O104:H4 str. 01-09591; identical to SEQ ID NO: 7885

SEQ ID NO: 17968 - protein, 118 aa, Escherichia coli O104:H4 str. 01-09591 [sequence omitted]

SEQ ID NO: 17969 - protein, 673 aa, Escherichia coli O104:H4 str. 01-09591; identical to SEQ ID NO: 6298

SEQ ID NO: 17970 - protein, 518 aa, Escherichia coli O104:H4 str. 01-09591; identical to SEQ ID NO: 6358

SEQ ID NO: 17971 - protein, 432 aa, Escherichia coli O104:H4 str. 01-09591; identical to SEQ ID NO: 5727

SEQ ID NO: 17972 - protein, 359 aa, Escherichia coli O104:H4 str. 01-09591; identical to SEQ ID NO: 6332

SEQ ID NO: 17973 - protein, 686 aa, Escherichia coli O104:H4 str. 01-09591; identical to SEQ ID NO: 6339

SEQ ID NO: 17974 - protein, 412 aa, Escherichia coli O104:H4 str. 01-09591; identical to SEQ ID NO: 6284

SEQ ID NO: 17975 - protein, 834 aa, Escherichia coli O104:H4 str. 01-09591
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSFSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDNYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 17976 - protein, 249 aa, Escherichia coli O104:H4 str. 01-09591; identical to SEQ ID NO: 6350

SEQ ID NO: 17977 - protein, 231 aa, Escherichia coli O104:H4 str. 01-09591; identical to SEQ ID NO: 6351

SEQ ID NO: 17978 - protein, 721 aa, Escherichia coli O104:H4 str. 01-09591
MDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWNYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 17979 - protein, 678 aa, Escherichia coli O104:H4 str. 01-09591; identical to SEQ ID NO: 6353

SEQ ID NO: 17980 - protein, 228 aa, Escherichia coli O104:H4 str. 01-09591; identical to SEQ ID NO: 6185

SEQ ID NO: 17981 - protein, 243 aa, Escherichia coli O104:H4 str. 01-09591; identical to SEQ ID NO: 6145

SEQ ID NO: 17982 - protein, 137 aa, Escherichia coli O104:H4 str. 01-09591
MITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWQVSASTNVMTFI

SEQ ID NO: 17983 - protein, 308 aa, Escherichia coli O104:H4 str. 01-09591
MIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNGDSKVNPNYGKAVTADFNGGSFGRGDSDEWTFGAQMEIWW

SEQ ID NO: 17984 - protein, 237 aa, Escherichia coli O104:H4 str. 01-09591; identical to SEQ ID NO: 6313

SEQ ID NO: 17985 - protein, 478 aa, Escherichia coli O104:H4 str. 01-09591; identical to SEQ ID NO: 5711

SEQ ID NO: 17986 - protein, 731 aa, Escherichia coli O104:H4 str. 01-09591
MRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLSLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 17987 - protein, 208 aa, Escherichia coli O104:H4 str. 01-09591; identical to SEQ ID NO: 5717

SEQ ID NO: 17988 - protein, 614 aa, Escherichia coli O104:H4 str. 01-09591; identical to SEQ ID NO: 6303

SEQ ID NO: 17989 - protein, 696 aa, Escherichia coli O104:H4 str. 01-09591; identical to SEQ ID NO: 12728

SEQ ID NO: 17990 - protein, 849 aa, Escherichia coli O104:H4 str. 01-09591; identical to SEQ ID NO: 6356

SEQ ID NO: 17991 - protein, 217 aa, Escherichia coli O104:H4 str. 01-09591
MFSLHLGATRVIYNIFSSGETLTIINDYDYPMLVQSEVLLEDQKTPAPFIITPPLFRLDALQSSRLRIVRTGGDFPKDRETLQWICVKGIPPKSDEKWAESNKNSLNNVTLNVQVSLSTCIKMFVRPSSVKGHPEDVAGEVKWQRVNNKLKGVNPTPFYINLSELRVGGEEISEHHYIAPFSSFEYPIPVSKSSKVQWKIVTDYGGVSEFFETDINL

SEQ ID NO: 17992 - protein, 120 aa, Escherichia coli O104:H4 str. 01-09591; identical to SEQ ID NO: 5917

SEQ ID NO: 17993 - protein, 774 aa, Escherichia coli O104:H4 str. 01-09591; identical to SEQ ID NO: 6325

SEQ ID NO: 17994 - protein, 89 aa, Escherichia coli O104:H4 str. 01-09591; identical to SEQ ID NO: 6233

SEQ ID NO: 17995 - protein, 539 aa, Escherichia coli O104:H4 str. 04-8351; identical to SEQ ID NO: 6525

SEQ ID NO: 17996 - protein, 696 aa, Escherichia coli O104:H4 str. 04-8351; identical to SEQ ID NO: 12728

SEQ ID NO: 17997 - protein, 191 aa, Escherichia coli O104:H4 str. 04-8351; identical to SEQ ID NO: 5748

SEQ ID NO: 17998 - protein, 232 aa, Escherichia coli O104:H4 str. 04-8351; identical to SEQ ID NO: 5747

SEQ ID NO: 17999 - protein, 729 aa, Escherichia coli O104:H4 str. 04-8351; identical to SEQ ID NO: 6336

SEQ ID NO: 18000 - protein, 213 aa, Escherichia coli O104:H4 str. 04-8351; identical to SEQ ID NO: 5744

SEQ ID NO: 18001 - protein, 203 aa, Escherichia coli O104:H4 str. 04-8351; identical to SEQ ID NO: 6347

SEQ ID NO: 18002 - protein, 565 aa, Escherichia coli O104:H4 str. 04-8351; identical to SEQ ID NO: 6395

SEQ ID NO: 18003 - protein, 207 aa, Escherichia coli O104:H4 str. 04-8351; identical to SEQ ID NO: 5743

SEQ ID NO: 18004 - protein, 700 aa, Escherichia coli O104:H4 str. 04-8351; identical to SEQ ID NO: 6287

SEQ ID NO: 18005 - protein, 883 aa, Escherichia coli O104:H4 str. 04-8351
MTAIRAAFKAYRMHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKSELLDNKEHSAEKHVPDNSACTPLQDRLADASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 18006 - protein, 236 aa, Escherichia coli O104:H4 str. 04-8351; identical to SEQ ID NO: 6472

SEQ ID NO: 18007 - protein, 102 aa, Escherichia coli O104:H4 str. 04-8351; identical to SEQ ID NO: 6285

SEQ ID NO: 18008 - protein, 118 aa, Escherichia coli O104:H4 str. 04-8351 [sequence omitted]

SEQ ID NO: 18009 - protein, 673 aa, Escherichia coli O104:H4 str. 04-8351; identical to SEQ ID NO: 6298

SEQ ID NO: 18010 - protein, 826 aa, Escherichia coli O104:H4 str. 04-8351; identical to SEQ ID NO: 6301

SEQ ID NO: 18011 - protein, 224 aa, Escherichia coli O104:H4 str. 04-8351; identical to SEQ ID NO: 6302

SEQ ID NO: 18012 - protein, 663 aa, Escherichia coli O104:H4 str. 04-8351; identical to SEQ ID NO: 6307

SEQ ID NO: 18013 - protein, 828 aa, Escherichia coli O104:H4 str. 04-8351; identical to SEQ ID NO: 6308

SEQ ID NO: 18014 - protein, 162 aa, Escherichia coli O104:H4 str. 04-8351; identical to SEQ ID NO: 5896

SEQ ID NO: 18015 - protein, 367 aa, Escherichia coli O104:H4 str. 04-8351; identical to SEQ ID NO: 6310

SEQ ID NO: 18016 - protein, 200 aa, Escherichia coli O104:H4 str. 04-8351; identical to SEQ ID NO: 6311

SEQ ID NO: 18017 - protein, 274 aa, Escherichia coli O104:H4 str. 04-8351; identical to SEQ ID NO: 6316

SEQ ID NO: 18018 - protein, 250 aa, Escherichia coli O104:H4 str. 04-8351; identical to SEQ ID NO: 6317

SEQ ID NO: 18019 - protein, 880 aa, Escherichia coli O104:H4 str. 04-8351; identical to SEQ ID NO: 6318

SEQ ID NO: 18020 - protein, 518 aa, Escherichia coli O104:H4 str. 04-8351; identical to SEQ ID NO: 6358

SEQ ID NO: 18021 - protein, 432 aa, Escherichia coli O104:H4 str. 04-8351; identical to SEQ ID NO: 5727

SEQ ID NO: 18022 - protein, 359 aa, Escherichia coli O104:H4 str. 04-8351; identical to SEQ ID NO: 6332

SEQ ID NO: 18023 - protein, 686 aa, Escherichia coli O104:H4 str. 04-8351; identical to SEQ ID NO: 6339

SEQ ID NO: 18024 - protein, 837 aa, Escherichia coli O104:H4 str. 04-8351; identical to SEQ ID NO: 6340

SEQ ID NO: 18025 - protein, 249 aa, Escherichia coli O104:H4 str. 04-8351; identical to SEQ ID NO: 6350

SEQ ID NO: 18026 - protein, 231 aa, Escherichia coli O104:H4 str. 04-8351; identical to SEQ ID NO: 6351

SEQ ID NO: 18027 - protein, 838 aa, Escherichia coli O104:H4 str. 04-8351; identical to SEQ ID NO: 6352

SEQ ID NO: 18028 - protein, 678 aa, Escherichia coli O104:H4 str. 04-8351; identical to SEQ ID NO: 6353

SEQ ID NO: 18029 - protein, 402 aa, Escherichia coli O104:H4 str. 04-8351
MLIPGVQAAKPQKVTLMVDDVPVAQVLQALAEQEKLNLVVSPDVSGTVSLHLTDVPWKQALQTVVKSAGLITRQEGNILSVHSIAWQNDNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 18030 - protein, 843 aa, Escherichia coli O104:H4 str. 04-8351; identical to SEQ ID NO: 6288

SEQ ID NO: 18031 - protein, 228 aa, Escherichia coli O104:H4 str. 04-8351; identical to SEQ ID NO: 6185

SEQ ID NO: 18032 - protein, 243 aa, Escherichia coli O104:H4 str. 04-8351; identical to SEQ ID NO: 6145

SEQ ID NO: 18033 - protein, 208 aa, Escherichia coli O104:H4 str. 04-8351; identical to SEQ ID NO: 5717

SEQ ID NO: 18034 - protein, 614 aa, Escherichia coli O104:H4 str. 04-8351; identical to SEQ ID NO: 6303

SEQ ID NO: 18035 - protein, 446 aa, Escherichia coli O104:H4 str. 04-8351; identical to SEQ ID NO: 6312

SEQ ID NO: 18036 - protein, 237 aa, Escherichia coli O104:H4 str. 04-8351; identical to SEQ ID NO: 6313

SEQ ID NO: 18037 - protein, 478 aa, Escherichia coli O104:H4 str. 04-8351; identical to SEQ ID NO: 5711

SEQ ID NO: 18038 - protein, 732 aa, Escherichia coli O104:H4 str. 04-8351
MMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLGQELVGQVYYRDESLRYYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLSLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 18039 - protein, 784 aa, Escherichia coli O104:H4 str. 04-8351; identical to SEQ ID NO: 6283

SEQ ID NO: 18040 - protein, 866 aa, Escherichia coli O104:H4 str. 04-8351; identical to SEQ ID NO: 17928

SEQ ID NO: 18041 - protein, 246 aa, Escherichia coli O104:H4 str. 04-8351; identical to SEQ ID NO: 6342

SEQ ID NO: 18042 - protein, 747 aa, Escherichia coli O104:H4 str. 04-8351; identical to SEQ ID NO: 6343

SEQ ID NO: 18043 - protein, 266 aa, Escherichia coli O104:H4 str. 04-8351; identical to SEQ ID NO: 5772

SEQ ID NO: 18044 - protein, 161 aa, Escherichia coli O104:H4 str. 04-8351; identical to SEQ ID NO: 5769

SEQ ID NO: 18045 - protein, 774 aa, Escherichia coli O104:H4 str. 04-8351; identical to SEQ ID NO: 6325

SEQ ID NO: 18046 - protein, 351 aa, Escherichia coli O104:H4 str. 04-8351; identical to SEQ ID NO: 6282

SEQ ID NO: 18047 - protein, 230 aa, Escherichia coli O104:H4 str. 04-8351; identical to SEQ ID NO: 6294

SEQ ID NO: 18048 - protein, 869 aa, Escherichia coli O104:H4 str. 04-8351; identical to SEQ ID NO: 17935

SEQ ID NO: 18049 - protein, 746 aa, Escherichia coli O104:H4 str. 04-8351; identical to SEQ ID NO: 6296

SEQ ID NO: 18050 - protein, 193 aa, Escherichia coli O104:H4 str. 04-8351; identical to SEQ ID NO: 6300

SEQ ID NO: 18051 - protein, 243 aa, Escherichia coli O104:H4 str. 04-8351; identical to SEQ ID NO: 6463

SEQ ID NO: 18052 - protein, 816 aa, Escherichia coli O104:H4 str. 04-8351; identical to SEQ ID NO: 17940

SEQ ID NO: 18053 - protein, 430 aa, Escherichia coli O104:H4 str. 04-8351; identical to SEQ ID NO: 5758

SEQ ID NO: 18054 - protein, 360 aa, Escherichia coli O104:H4 str. 04-8351; identical to SEQ ID NO: 6315

SEQ ID NO: 18055 - protein, 331 aa, Escherichia coli O104:H4 str. 04-8351; identical to SEQ ID NO: 6456

SEQ ID NO: 18056 - protein, 760 aa, Escherichia coli O104:H4 str. 04-8351; identical to SEQ ID NO: 6322

SEQ ID NO: 18057 - protein, 203 aa, Escherichia coli O104:H4 str. 04-8351; identical to SEQ ID NO: 6414

SEQ ID NO: 18058 - protein, 362 aa, Escherichia coli O104:H4 str. 04-8351; identical to SEQ ID NO: 5809

SEQ ID NO: 18059 - protein, 233 aa, Escherichia coli O104:H4 str. 04-8351; identical to SEQ ID NO: 6327

SEQ ID NO: 18060 - protein, 653 aa, Escherichia coli O104:H4 str. 04-8351
MRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 18061 - protein, 229 aa, Escherichia coli O104:H4 str. 04-8351; identical to SEQ ID NO: 9369

SEQ ID NO: 18062 - protein, 89 aa, Escherichia coli O104:H4 str. 04-8351; identical to SEQ ID NO: 6233

SEQ ID NO: 18063 - protein, 300 aa, Escherichia coli O104:H4 str. 04-8351; identical to SEQ ID NO: 5919

SEQ ID NO: 18064 - protein, 751 aa, Escherichia coli O104:H4 str. 04-8351
MRYGVKTEKYPKLFLSHYGKKDERQCADLSVIPQATEEFLFEAQKLVLSIPQVAIRSPLRGVASDLIWEDGISTFLLNWQVEAGHSEFQHYEKTTSDNFWVSLEPGINIGPWRIRNLTTLNKSSGQVGKWESSYIRAERGLNNIKSRLTLGEDYTPADIFASVPFRGVMLGTDENMIPYDQRGFAPVIRGIARTQARIEIRQNGYLIQSQTVAAGPFALTDLPITGSGGEFQVTIFESDGAIQSFNVPFTTPAIALREGYLKYNISAGQYRSSDESVEKAYLWQATAMYGLPRALTVFGGVQTAEHYQAAALGVGLSLGNMGAASLDTIYSRGQQKGYDFDTGNSWRIRYDKSFELTDTSFSAASYQYSNEGYHELSDILDTYRSGANFVFNDTDRKRRRITININQSLGPWGFIGLSGGRDEYKGGDRQDYIGASYSMSWKDISFSVNWTRNRNVGDYFSNRTFNEDTVGMWMSIPLKHWLGKNDNDVNATAQIQHSTRQNTRYEMGLNGRAFDQKLYWDIREQIVPGSKYDADTSRLNMRWSGSYGELVGMYSYNSHTRQMNAGMSGSIAMHSEGITFGQRFGDTMALIAAPGVRGASVGGWPGVSTDSRGYALVSYITPYQENIITLDPTTFPENAEVLQTDTRVVPTKGAVVRAKFKTRVGNRAVVRLARADGTPLPFGTVVTLEGKTEVSNSTGVVDDKGMVYLSGLSEAGKLKAQWGMNSHCYANYRLPVKKGPAGLYLTSAVCI

SEQ ID NO: 18065 - protein, 120 aa, Escherichia coli O104:H4 str. 04-8351; identical to SEQ ID NO: 5917

SEQ ID NO: 18066 - protein, 696 aa, Escherichia coli O104:H4 str. 09-7901; identical to SEQ ID NO: 12728

SEQ ID NO: 18067 - protein, 774 aa, Escherichia coli O104:H4 str. 09-7901; identical to SEQ ID NO: 6325

SEQ ID NO: 18068 - protein, 784 aa, Escherichia coli O104:H4 str. 09-7901; identical to SEQ ID NO: 6283

SEQ ID NO: 18069 - protein, 866 aa, Escherichia coli O104:H4 str. 09-7901; identical to SEQ ID NO: 17928

SEQ ID NO: 18070 - protein, 246 aa, Escherichia coli O104:H4 str. 09-7901; identical to SEQ ID NO: 6342

SEQ ID NO: 18071 - protein, 747 aa, Escherichia coli O104:H4 str. 09-7901; identical to SEQ ID NO: 6343

SEQ ID NO: 18072 - protein, 266 aa, Escherichia coli O104:H4 str. 09-7901; identical to SEQ ID NO: 5772

SEQ ID NO: 18073 - protein, 161 aa, Escherichia coli O104:H4 str. 09-7901; identical to SEQ ID NO: 5769

SEQ ID NO: 18074 - protein, 351 aa, Escherichia coli O104:H4 str. 09-7901; identical to SEQ ID NO: 6282

SEQ ID NO: 18075 - protein, 230 aa, Escherichia coli O104:H4 str. 09-7901; identical to SEQ ID NO: 6294

SEQ ID NO: 18076 - protein, 869 aa, Escherichia coli O104:H4 str. 09-7901; identical to SEQ ID NO: 17935

SEQ ID NO: 18077 - protein, 746 aa, Escherichia coli O104:H4 str. 09-7901; identical to SEQ ID NO: 6296

SEQ ID NO: 18078 - protein, 193 aa, Escherichia coli O104:H4 str. 09-7901; identical to SEQ ID NO: 6300

SEQ ID NO: 18079 - protein, 360 aa, Escherichia coli O104:H4 str. 09-7901; identical to SEQ ID NO: 6315

SEQ ID NO: 18080 - protein, 331 aa, Escherichia coli O104:H4 str. 09-7901; identical to SEQ ID NO: 6456

SEQ ID NO: 18081 - protein, 760 aa, Escherichia coli O104:H4 str. 09-7901; identical to SEQ ID NO: 6322

SEQ ID NO: 18082 - protein, 203 aa, Escherichia coli O104:H4 str. 09-7901; identical to SEQ ID NO: 6414

SEQ ID NO: 18083 - protein, 362 aa, Escherichia coli O104:H4 str. 09-7901; identical to SEQ ID NO: 5809

SEQ ID NO: 18084 - protein, 233 aa, Escherichia coli O104:H4 str. 09-7901; identical to SEQ ID NO: 6327

SEQ ID NO: 18085 - protein, 653 aa, Escherichia coli O104:H4 str. 09-7901; identical to SEQ ID NO: 18060

SEQ ID NO: 18086 - protein, 229 aa, Escherichia coli O104:H4 str. 09-7901; identical to SEQ ID NO: 9369

SEQ ID NO: 18087 - protein, 89 aa, Escherichia coli O104:H4 str. 09-7901; identical to SEQ ID NO: 6233

SEQ ID NO: 18088 - protein, 191 aa, Escherichia coli O104:H4 str. 09-7901; identical to SEQ ID NO: 5748

SEQ ID NO: 18089 - protein, 232 aa, Escherichia coli O104:H4 str. 09-7901; identical to SEQ ID NO: 5747

SEQ ID NO: 18090 - protein, 729 aa, Escherichia coli O104:H4 str. 09-7901; identical to SEQ ID NO: 6336

SEQ ID NO: 18091 - protein, 213 aa, Escherichia coli O104:H4 str. 09-7901; identical to SEQ ID NO: 5744

SEQ ID NO: 18092 - protein, 203 aa, Escherichia coli O104:H4 str. 09-7901; identical to SEQ ID NO: 6347

SEQ ID NO: 18093 - protein, 565 aa, Escherichia coli O104:H4 str. 09-7901; identical to SEQ ID NO: 6395

SEQ ID NO: 18094 - protein, 207 aa, Escherichia coli O104:H4 str. 09-7901; identical to SEQ ID NO: 5743

SEQ ID NO: 18095 - protein, 539 aa, Escherichia coli O104:H4 str. 09-7901; identical to SEQ ID NO: 6525

SEQ ID NO: 18096 - protein, 700 aa, Escherichia coli O104:H4 str. 09-7901; identical to SEQ ID NO: 6287

SEQ ID NO: 18097 - protein, 883 aa, Escherichia coli O104:H4 str. 09-7901; identical to SEQ ID NO: 18005

SEQ ID NO: 18098 - protein, 236 aa, Escherichia coli O104:H4 str. 09-7901; identical to SEQ ID NO: 6472

SEQ ID NO: 18099 - protein, 243 aa, Escherichia coli O104:H4 str. 09-7901; identical to SEQ ID NO: 6463

SEQ ID NO: 18100 - protein, 816 aa, Escherichia coli O104:H4 str. 09-7901; identical to SEQ ID NO: 17940

SEQ ID NO: 18101 - protein, 430 aa, Escherichia coli O104:H4 str. 09-7901; identical to SEQ ID NO: 5758

SEQ ID NO: 18102 - protein, 102 aa, Escherichia coli O104:H4 str. 09-7901; identical to SEQ ID NO: 6285

SEQ ID NO: 18103 - protein, 359 aa, Escherichia coli O104:H4 str. 09-7901; identical to SEQ ID NO: 6332

SEQ ID NO: 18104 - protein, 118 aa, Escherichia coli O104:H4 str. 09-7901 [sequence omitted]

SEQ ID NO: 18105 - protein, 673 aa, Escherichia coli O104:H4 str. 09-7901; identical to SEQ ID NO: 6298

SEQ ID NO: 18106 - protein, 826 aa, Escherichia coli O104:H4 str. 09-7901; identical to SEQ ID NO: 6301

SEQ ID NO: 18107 - protein, 224 aa, Escherichia coli O104:H4 str. 09-7901; identical to SEQ ID NO: 6302

SEQ ID NO: 18108 - protein, 663 aa, Escherichia coli O104:H4 str. 09-7901; identical to SEQ ID NO: 6307

SEQ ID NO: 18109 - protein, 828 aa, Escherichia coli O104:H4 str. 09-7901; identical to SEQ ID NO: 6308

SEQ ID NO: 18110 - protein, 162 aa, Escherichia coli O104:H4 str. 09-7901; identical to SEQ ID NO: 5896

SEQ ID NO: 18111 - protein, 367 aa, Escherichia coli O104:H4 str. 09-7901; identical to SEQ ID NO: 6310

SEQ ID NO: 18112 - protein, 200 aa, Escherichia coli O104:H4 str. 09-7901; identical to SEQ ID NO: 6311

SEQ ID NO: 18113 - protein, 274 aa, Escherichia coli O104:H4 str. 09-7901; identical to SEQ ID NO: 6316

SEQ ID NO: 18114 - protein, 250 aa, Escherichia coli O104:H4 str. 09-7901; identical to SEQ ID NO: 6317

SEQ ID NO: 18115 - protein, 880 aa, Escherichia coli O104:H4 str. 09-7901; identical to SEQ ID NO: 6318

SEQ ID NO: 18116 - protein, 518 aa, Escherichia coli O104:H4 str. 09-7901; identical to SEQ ID NO: 6358

SEQ ID NO: 18117 - protein, 432 aa, Escherichia coli O104:H4 str. 09-7901; identical to SEQ ID NO: 5727

SEQ ID NO: 18118 - protein, 686 aa, Escherichia coli O104:H4 str. 09-7901; identical to SEQ ID NO: 6339

SEQ ID NO: 18119 - protein, 837 aa, Escherichia coli O104:H4 str. 09-7901; identical to SEQ ID NO: 6340

SEQ ID NO: 18120 - protein, 249 aa, Escherichia coli O104:H4 str. 09-7901; identical to SEQ ID NO: 6350

SEQ ID NO: 18121 - protein, 231 aa, Escherichia coli O104:H4 str. 09-7901; identical to SEQ ID NO: 6351

SEQ ID NO: 18122 - protein, 838 aa, Escherichia coli O104:H4 str. 09-7901; identical to SEQ ID NO: 6352

SEQ ID NO: 18123 - protein, 678 aa, Escherichia coli O104:H4 str. 09-7901; identical to SEQ ID NO: 6353

SEQ ID NO: 18124 - protein, 243 aa, Escherichia coli O104:H4 str. 09-7901; identical to SEQ ID NO: 6145

SEQ ID NO: 18125 - protein, 402 aa, Escherichia coli O104:H4 str. 09-7901; identical to SEQ ID NO: 18029

SEQ ID NO: 18126 - protein, 843 aa, Escherichia coli O104:H4 str. 09-7901; identical to SEQ ID NO: 6288

SEQ ID NO: 18127 - protein, 228 aa, Escherichia coli O104:H4 str. 09-7901; identical to SEQ ID NO: 6185

SEQ ID NO: 18128 - protein, 208 aa, Escherichia coli O104:H4 str. 09-7901; identical to SEQ ID NO: 5717

SEQ ID NO: 18129 - protein, 614 aa, Escherichia coli O104:H4 str. 09-7901; identical to SEQ ID NO: 6303

SEQ ID NO: 18130 - protein, 446 aa, Escherichia coli O104:H4 str. 09-7901; identical to SEQ ID NO: 6312

SEQ ID NO: 18131 - protein, 237 aa, Escherichia coli O104:H4 str. 09-7901; identical to SEQ ID NO: 6313

SEQ ID NO: 18132 - protein, 478 aa, Escherichia coli O104:H4 str. 09-7901; identical to SEQ ID NO: 5711

SEQ ID NO: 18133 - protein, 731 aa, Escherichia coli O104:H4 str. 09-7901; identical to SEQ ID NO: 17986

SEQ ID NO: 18134 - protein, 300 aa, Escherichia coli O104:H4 str. 09-7901; identical to SEQ ID NO: 5919

SEQ ID NO: 18135 - protein, 751 aa, Escherichia coli O104:H4 str. 09-7901; identical to SEQ ID NO: 18064

SEQ ID NO: 18136 - protein, 120 aa, Escherichia coli O104:H4 str. 09-7901; identical to SEQ ID NO: 5917

SEQ ID NO: 18137 - protein, 774 aa, Escherichia coli O104:H4 str. 11-3677
MTPLRVFRKTTPLVNAIRLSLLPLAGLSFSAFAAQVNIAPGSLDKALNQYAAHSGFTLSVDASLTRDKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPISLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 18138 - protein, 784 aa, Escherichia coli O104:H4 str. 11-3677; identical to SEQ ID NO: 6283

SEQ ID NO: 18139 - protein, 866 aa, Escherichia coli O104:H4 str. 11-3677; identical to SEQ ID NO: 17928

SEQ ID NO: 18140 - protein, 246 aa, Escherichia coli O104:H4 str. 11-3677; identical to SEQ ID NO: 6342

SEQ ID NO: 18141 - protein, 747 aa, Escherichia coli O104:H4 str. 11-3677; identical to SEQ ID NO: 6343

SEQ ID NO: 18142 - protein, 266 aa, Escherichia coli O104:H4 str. 11-3677; identical to SEQ ID NO: 5772

SEQ ID NO: 18143 - protein, 161 aa, Escherichia coli O104:H4 str. 11-3677; identical to SEQ ID NO: 5769

SEQ ID NO: 18144 - protein, 732 aa, Escherichia coli O104:H4 str. 11-3677; identical to SEQ ID NO: 18038

SEQ ID NO: 18145 - protein, 351 aa, Escherichia coli O104:H4 str. 11-3677; identical to SEQ ID NO: 6282

SEQ ID NO: 18146 - protein, 230 aa, Escherichia coli O104:H4 str. 11-3677; identical to SEQ ID NO: 6294

SEQ ID NO: 18147 - protein, 869 aa, Escherichia coli O104:H4 str. 11-3677; identical to SEQ ID NO: 17935

SEQ ID NO: 18148 - protein, 746 aa, Escherichia coli O104:H4 str. 11-3677; identical to SEQ ID NO: 6296

SEQ ID NO: 18149 - protein, 193 aa, Escherichia coli O104:H4 str. 11-3677; identical to SEQ ID NO: 6300

SEQ ID NO: 18150 - protein, 360 aa, Escherichia coli O104:H4 str. 11-3677; identical to SEQ ID NO: 6315

SEQ ID NO: 18151 - protein, 430 aa, Escherichia coli O104:H4 str. 11-3677; identical to SEQ ID NO: 5758

SEQ ID NO: 18152 - protein, 203 aa, Escherichia coli O104:H4 str. 11-3677; identical to SEQ ID NO: 6414

SEQ ID NO: 18153 - protein, 89 aa, Escherichia coli O104:H4 str. 11-3677; identical to SEQ ID NO: 6233

SEQ ID NO: 18154 - protein, 191 aa, Escherichia coli O104:H4 str. 11-3677; identical to SEQ ID NO: 5748

SEQ ID NO: 18155 - protein, 331 aa, Escherichia coli O104:H4 str. 11-3677; identical to SEQ ID NO: 6456

SEQ ID NO: 18156 - protein, 760 aa, Escherichia coli O104:H4 str. 11-3677; identical to SEQ ID NO: 6322

SEQ ID NO: 18157 - protein, 362 aa, Escherichia coli O104:H4 str. 11-3677; identical to SEQ ID NO: 5809

SEQ ID NO: 18158 - protein, 232 aa, Escherichia coli O104:H4 str. 11-3677; identical to SEQ ID NO: 5747

SEQ ID NO: 18159 - protein, 233 aa, Escherichia coli O104:H4 str. 11-3677; identical to SEQ ID NO: 6327

SEQ ID NO: 18160 - protein, 866 aa, Escherichia coli O104:H4 str. 11-3677; identical to SEQ ID NO: 6328

SEQ ID NO: 18161 - protein, 229 aa, Escherichia coli O104:H4 str. 11-3677; identical to SEQ ID NO: 9369

SEQ ID NO: 18162 - protein, 729 aa, Escherichia coli O104:H4 str. 11-3677; identical to SEQ ID NO: 6336

SEQ ID NO: 18163 - protein, 213 aa, Escherichia coli O104:H4 str. 11-3677; identical to SEQ ID NO: 5744

SEQ ID NO: 18164 - protein, 696 aa, Escherichia coli O104:H4 str. 11-3677; identical to SEQ ID NO: 12728

SEQ ID NO: 18165 - protein, 203 aa, Escherichia coli O104:H4 str. 11-3677; identical to SEQ ID NO: 6347

SEQ ID NO: 18166 - protein, 565 aa, Escherichia coli O104:H4 str. 11-3677; identical to SEQ ID NO: 6395

SEQ ID NO: 18167 - protein, 207 aa, Escherichia coli O104:H4 str. 11-3677; identical to SEQ ID NO: 5743

SEQ ID NO: 18168 - protein, 539 aa, Escherichia coli O104:H4 str. 11-3677; identical to SEQ ID NO: 6525

SEQ ID NO: 18169 - protein, 700 aa, Escherichia coli O104:H4 str. 11-3677; identical to SEQ ID NO: 6287

SEQ ID NO: 18170 - protein, 883 aa, Escherichia coli O104:H4 str. 11-3677; identical to SEQ ID NO: 18005

SEQ ID NO: 18171 - protein, 236 aa, Escherichia coli O104:H4 str. 11-3677; identical to SEQ ID NO: 6472

SEQ ID NO: 18172 - protein, 102 aa, Escherichia coli O104:H4 str. 11-3677; identical to SEQ ID NO: 6285

SEQ ID NO: 18173 - protein, 118 aa, Escherichia coli O104:H4 str. 11-3677 [sequence omitted]

SEQ ID NO: 18174 - protein, 359 aa, Escherichia coli O104:H4 str. 11-3677; identical to SEQ ID NO: 6332

SEQ ID NO: 18175 - protein, 826 aa, Escherichia coli O104:H4 str. 11-3677; identical to SEQ ID NO: 6301

SEQ ID NO: 18176 - protein, 224 aa, Escherichia coli O104:H4 str. 11-3677; identical to SEQ ID NO: 6302

SEQ ID NO: 18177 - protein, 518 aa, Escherichia coli O104:H4 str. 11-3677; identical to SEQ ID NO: 6358

SEQ ID NO: 18178 - protein, 663 aa, Escherichia coli O104:H4 str. 11-3677; identical to SEQ ID NO: 6307

SEQ ID NO: 18179 - protein, 828 aa, Escherichia coli O104:H4 str. 11-3677; identical to SEQ ID NO: 6308

SEQ ID NO: 18180 - protein, 162 aa, Escherichia coli O104:H4 str. 11-3677; identical to SEQ ID NO: 5896

SEQ ID NO: 18181 - protein, 367 aa, Escherichia coli O104:H4 str. 11-3677; identical to SEQ ID NO: 6310

SEQ ID NO: 18182 - protein, 200 aa, Escherichia coli O104:H4 str. 11-3677; identical to SEQ ID NO: 6311

SEQ ID NO: 18183 - protein, 274 aa, Escherichia coli O104:H4 str. 11-3677; identical to SEQ ID NO: 6316

SEQ ID NO: 18184 - protein, 250 aa, Escherichia coli O104:H4 str. 11-3677; identical to SEQ ID NO: 6317

SEQ ID NO: 18185 - protein, 880 aa, Escherichia coli O104:H4 str. 11-3677
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVANNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVQRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 18186 - protein, 432 aa, Escherichia coli O104:H4 str. 11-3677; identical to SEQ ID NO: 5727

SEQ ID NO: 18187 - protein, 673 aa, Escherichia coli O104:H4 str. 11-3677; identical to SEQ ID NO: 6298

SEQ ID NO: 18188 - protein, 686 aa, Escherichia coli O104:H4 str. 11-3677; identical to SEQ ID NO: 6339

SEQ ID NO: 18189 - protein, 837 aa, Escherichia coli O104:H4 str. 11-3677; identical to SEQ ID NO: 6340

SEQ ID NO: 18190 - protein, 249 aa, Escherichia coli O104:H4 str. 11-3677; identical to SEQ ID NO: 6350

SEQ ID NO: 18191 - protein, 231 aa, Escherichia coli O104:H4 str. 11-3677; identical to SEQ ID NO: 6351

SEQ ID NO: 18192 - protein, 838 aa, Escherichia coli O104:H4 str. 11-3677; identical to SEQ ID NO: 6352

SEQ ID NO: 18193 - protein, 678 aa, Escherichia coli O104:H4 str. 11-3677; identical to SEQ ID NO: 6353

SEQ ID NO: 18194 - protein, 402 aa, Escherichia coli O104:H4 str. 11-3677; identical to SEQ ID NO: 18029

SEQ ID NO: 18195 - protein, 843 aa, Escherichia coli O104:H4 str. 11-3677; identical to SEQ ID NO: 6288

SEQ ID NO: 18196 - protein, 228 aa, Escherichia coli O104:H4 str. 11-3677; identical to SEQ ID NO: 6185

SEQ ID NO: 18197 - protein, 243 aa, Escherichia coli O104:H4 str. 11-3677; identical to SEQ ID NO: 6145

SEQ ID NO: 18198 - protein, 614 aa, Escherichia coli O104:H4 str. 11-3677; identical to SEQ ID NO: 6303

SEQ ID NO: 18199 - protein, 208 aa, Escherichia coli O104:H4 str. 11-3677; identical to SEQ ID NO: 5717

SEQ ID NO: 18200 - protein, 446 aa, Escherichia coli O104:H4 str. 11-3677; identical to SEQ ID NO: 6312

SEQ ID NO: 18201 - protein, 237 aa, Escherichia coli O104:H4 str. 11-3677; identical to SEQ ID NO: 6313

SEQ ID NO: 18202 - protein, 478 aa, Escherichia coli O104:H4 str. 11-3677; identical to SEQ ID NO: 5711

SEQ ID NO: 18203 - protein, 198 aa, Escherichia coli O104:H4 str. 11-3677
MAVINEHNYPILVQANVLSEDQKNIAPFIITPPLFRLDALQSSRLRIVKTEGAFPIDRESLQWICVKAIPPKYEDKWAKEEVSGKKSDEATMNIQVSVSSCIKLFVRPADVKGQPDDVAGKIKWQKVGNKLKGVNPTPFYMDIAELRVGEKEITETHYIAPFSSYEYPMPVNGGGDVRWKVVTDYGGISKTFETGLNI

SEQ ID NO: 18204 - protein, 794 aa, Escherichia coli O104:H4 str. 11-3677
MPGIYPVDIILNGSRIDSRDIFFYTKKNRHGEYYLKPCLTRDILINYGVKIEEYPNLFRQNSEKNRDSSDCADLSVIPQATEDYHFIKQQLILGIPQVAIHPPLTGIAHETMWDDGISAFLLNWQVEGGHWEYRSNTRNSSDNFWASLEPGINLGSWRIRNLTTWNKSSGQSGKWESSYIRVERGLNNIKSRLTFGDDYTPSDIFDSVPFRGGMLGSDENMVPYNQREFAPVVRGIARTQARIEVRQNGYLIQSRIVSPGAFALTDLPVTGNGGDLQVWVLESDGTIQTFNVPFTTPAIALREGYLKYNVTVGEYRPSDDSIEGAYLGQLTAMYGLPWSLTAFGGIQVSEHYQGNALGLGLSLGGFGSISLDTIYSRGQQKGYSNEIGKTWRVRYDKSFELTGTSFAAGYQDSSAGYHSLADVLDTYRNGTAYRSYDNRIRRTTINISQALGEWGSVALNGGRDEYRDKVKQDYIGASYSNSWKGITFAVNWSRNNNIGDYYSNSLRTENNLNLWMSIPMKRWLGGDDKGVTATAQIQRITGQNTLYETGLNGRAFGQKLYWDIREQIVPGSKYDADTSLLNLRWSGGYGELTGMYSYNRNTRQMNVGTSGSMAIHSGGIAFGQKTDDTMALIAAPGIAGASVGGWPGVSTDFRGYTLVGHVSPYQENIITLDPTTFPDNTEVSQTDRRVIPTKGALVQAEFKTRVGNRALVTLTRKDGTLLPFGTVVTLERKTGEAFESAGVVDDKGKVYLSGLSEAGKLKAQWGTNSQCYADYKLPLKKGMSGIFLTRAVCM

SEQ ID NO: 18205 - protein, 102 aa, Escherichia coli O104:H4 str. 11-4404; identical to SEQ ID NO: 6285

SEQ ID NO: 18206 - protein, 118 aa, Escherichia coli O104:H4 str. 11-4404 [sequence omitted]

SEQ ID NO: 18207 - protein, 673 aa, Escherichia coli O104:H4 str. 11-4404; identical to SEQ ID NO: 6298

SEQ ID NO: 18208 - protein, 200 aa, Escherichia coli O104:H4 str. 11-4404; identical to SEQ ID NO: 6311

SEQ ID NO: 18209 - protein, 274 aa, Escherichia coli O104:H4 str. 11-4404; identical to SEQ ID NO: 6316

SEQ ID NO: 18210 - protein, 250 aa, Escherichia coli O104:H4 str. 11-4404; identical to SEQ ID NO: 6317

SEQ ID NO: 18211 - protein, 880 aa, Escherichia coli O104:H4 str. 11-4404; identical to SEQ ID NO: 18185

SEQ ID NO: 18212 - protein, 826 aa, Escherichia coli O104:H4 str. 11-4404; identical to SEQ ID NO: 6301

SEQ ID NO: 18213 - protein, 224 aa, Escherichia coli O104:H4 str. 11-4404; identical to SEQ ID NO: 6302

SEQ ID NO: 18214 - protein, 663 aa, Escherichia coli O104:H4 str. 11-4404; identical to SEQ ID NO: 6307

SEQ ID NO: 18215 - protein, 828 aa, Escherichia coli O104:H4 str. 11-4404; identical to SEQ ID NO: 6308

SEQ ID NO: 18216 - protein, 162 aa, Escherichia coli O104:H4 str. 11-4404; identical to SEQ ID NO: 5896

SEQ ID NO: 18217 - protein, 367 aa, Escherichia coli O104:H4 str. 11-4404; identical to SEQ ID NO: 6310

SEQ ID NO: 18218 - protein, 518 aa, Escherichia coli O104:H4 str. 11-4404; identical to SEQ ID NO: 6358

SEQ ID NO: 18219 - protein, 432 aa, Escherichia coli O104:H4 str. 11-4404; identical to SEQ ID NO: 5727

SEQ ID NO: 18220 - protein, 359 aa, Escherichia coli O104:H4 str. 11-4404; identical to SEQ ID NO: 6332

SEQ ID NO: 18221 - protein, 686 aa, Escherichia coli O104:H4 str. 11-4404; identical to SEQ ID NO: 6339

SEQ ID NO: 18222 - protein, 837 aa, Escherichia coli O104:H4 str. 11-4404; identical to SEQ ID NO: 6340

SEQ ID NO: 18223 - protein, 249 aa, Escherichia coli O104:H4 str. 11-4404; identical to SEQ ID NO: 6350

SEQ ID NO: 18224 - protein, 231 aa, Escherichia coli O104:H4 str. 11-4404; identical to SEQ ID NO: 6351

SEQ ID NO: 18225 - protein, 838 aa, Escherichia coli O104:H4 str. 11-4404; identical to SEQ ID NO: 6352

SEQ ID NO: 18226 - protein, 678 aa, Escherichia coli O104:H4 str. 11-4404; identical to SEQ ID NO: 6353

SEQ ID NO: 18227 - protein, 402 aa, Escherichia coli O104:H4 str. 11-4404; identical to SEQ ID NO: 18029

SEQ ID NO: 18228 - protein, 843 aa, Escherichia coli O104:H4 str. 11-4404; identical to SEQ ID NO: 6288

SEQ ID NO: 18229 - protein, 228 aa, Escherichia coli O104:H4 str. 11-4404; identical to SEQ ID NO: 6185

SEQ ID NO: 18230 - protein, 243 aa, Escherichia coli O104:H4 str. 11-4404; identical to SEQ ID NO: 6145

SEQ ID NO: 18231 - protein, 208 aa, Escherichia coli O104:H4 str. 11-4404; identical to SEQ ID NO: 5717

SEQ ID NO: 18232 - protein, 614 aa, Escherichia coli O104:H4 str. 11-4404; identical to SEQ ID NO: 6303

SEQ ID NO: 18233 - protein, 237 aa, Escherichia coli O104:H4 str. 11-4404; identical to SEQ ID NO: 6313

SEQ ID NO: 18234 - protein, 478 aa, Escherichia coli O104:H4 str. 11-4404; identical to SEQ ID NO: 5711

SEQ ID NO: 18235 - protein, 446 aa, Escherichia coli O104:H4 str. 11-4404; identical to SEQ ID NO: 6312

SEQ ID NO: 18236 - protein, 732 aa, Escherichia coli O104:H4 str. 11-4404; identical to SEQ ID NO: 18038

SEQ ID NO: 18237 - protein, 774 aa, Escherichia coli O104:H4 str. 11-4404; identical to SEQ ID NO: 18137

SEQ ID NO: 18238 - protein, 784 aa, Escherichia coli O104:H4 str. 11-4404; identical to SEQ ID NO: 6283

SEQ ID NO: 18239 - protein, 866 aa, Escherichia coli O104:H4 str. 11-4404; identical to SEQ ID NO: 17928

SEQ ID NO: 18240 - protein, 246 aa, Escherichia coli O104:H4 str. 11-4404; identical to SEQ ID NO: 6342

SEQ ID NO: 18241 - protein, 747 aa, Escherichia coli O104:H4 str. 11-4404; identical to SEQ ID NO: 6343

SEQ ID NO: 18242 - protein, 266 aa, Escherichia coli O104:H4 str. 11-4404; identical to SEQ ID NO: 5772

SEQ ID NO: 18243 - protein, 161 aa, Escherichia coli O104:H4 str. 11-4404; identical to SEQ ID NO: 5769

SEQ ID NO: 18244 - protein, 351 aa, Escherichia coli O104:H4 str. 11-4404; identical to SEQ ID NO: 6282

SEQ ID NO: 18245 - protein, 230 aa, Escherichia coli O104:H4 str. 11-4404; identical to SEQ ID NO: 6294

SEQ ID NO: 18246 - protein, 869 aa, Escherichia coli O104:H4 str. 11-4404; identical to SEQ ID NO: 17935

SEQ ID NO: 18247 - protein, 746 aa, Escherichia coli O104:H4 str. 11-4404; identical to SEQ ID NO: 6296

SEQ ID NO: 18248 - protein, 193 aa, Escherichia coli O104:H4 str. 11-4404; identical to SEQ ID NO: 6300

SEQ ID NO: 18249 - protein, 430 aa, Escherichia coli O104:H4 str. 11-4404; identical to SEQ ID NO: 5758

SEQ ID NO: 18250 - protein, 331 aa, Escherichia coli O104:H4 str. 11-4404; identical to SEQ ID NO: 6456

SEQ ID NO: 18251 - protein, 760 aa, Escherichia coli O104:H4 str. 11-4404; identical to SEQ ID NO: 6322

SEQ ID NO: 18252 - protein, 360 aa, Escherichia coli O104:H4 str. 11-4404; identical to SEQ ID NO: 6315

SEQ ID NO: 18253 - protein, 203 aa, Escherichia coli O104:H4 str. 11-4404; identical to SEQ ID NO: 6414

SEQ ID NO: 18254 - protein, 362 aa, Escherichia coli O104:H4 str. 11-4404; identical to SEQ ID NO: 5809

SEQ ID NO: 18255 - protein, 233 aa, Escherichia coli O104:H4 str. 11-4404; identical to SEQ ID NO: 6327

SEQ ID NO: 18256 - protein, 866 aa, Escherichia coli O104:H4 str. 11-4404; identical to SEQ ID NO: 6328

SEQ ID NO: 18257 - protein, 229 aa, Escherichia coli O104:H4 str. 11-4404; identical to SEQ ID NO: 9369

SEQ ID NO: 18258 - protein, 89 aa, Escherichia coli O104:H4 str. 11-4404; identical to SEQ ID NO: 6233

SEQ ID NO: 18259 - protein, 696 aa, Escherichia coli O104:H4 str. 11-4404; identical to SEQ ID NO: 12728

SEQ ID NO: 18260 - protein, 191 aa, Escherichia coli O104:H4 str. 11-4404; identical to SEQ ID NO: 5748

SEQ ID NO: 18261 - protein, 232 aa, Escherichia coli O104:H4 str. 11-4404; identical to SEQ ID NO: 5747

SEQ ID NO: 18262 - protein, 729 aa, Escherichia coli O104:H4 str. 11-4404; identical to SEQ ID NO: 6336

SEQ ID NO: 18263 - protein, 213 aa, Escherichia coli O104:H4 str. 11-4404; identical to SEQ ID NO: 5744

SEQ ID NO: 18264 - protein, 203 aa, Escherichia coli O104:H4 str. 11-4404; identical to SEQ ID NO: 6347

SEQ ID NO: 18265 - protein, 565 aa, Escherichia coli O104:H4 str. 11-4404; identical to SEQ ID NO: 6395

SEQ ID NO: 18266 - protein, 207 aa, Escherichia coli O104:H4 str. 11-4404; identical to SEQ ID NO: 5743

SEQ ID NO: 18267 - protein, 539 aa, Escherichia coli O104:H4 str. 11-4404; identical to SEQ ID NO: 6525

SEQ ID NO: 18268 - protein, 700 aa, Escherichia coli O104:H4 str. 11-4404; identical to SEQ ID NO: 6287

SEQ ID NO: 18269 - protein, 883 aa, Escherichia coli O104:H4 str. 11-4404; identical to SEQ ID NO: 18005

SEQ ID NO: 18270 - protein, 236 aa, Escherichia coli O104:H4 str. 11-4404; identical to SEQ ID NO: 6472

SEQ ID NO: 18271 - protein, 209 aa, Escherichia coli O104:H4 str. 11-4404
MLYKPNSSGETLAVINEHNYPILVQANVLSEDQKNIAPFIITPPLFRLDALQSSRLRIVKTEGAFPIDRESLQWICVKAIPPKYEDKWAKEEVSGKKSDEATMNIQVSVSSCIKLFVRPADVKGQPDDVAGKIKWQKVGNKLKGVNPTPFYMDIAELRVGEKEITETHYIAPFSSYEYPMPVNGGGDVRWKVVTDYGGISKTFETGLNI

SEQ ID NO: 18272 - protein, 794 aa, Escherichia coli O104:H4 str. 11-4404; identical to SEQ ID NO: 18204

SEQ ID NO: 18273 - protein, 102 aa, Escherichia coli O104:H4 str. 11-4522; identical to SEQ ID NO: 6285

SEQ ID NO: 18274 - protein, 118 aa, Escherichia coli O104:H4 str. 11-4522 [sequence omitted]

SEQ ID NO: 18275 - protein, 673 aa, Escherichia coli O104:H4 str. 11-4522; identical to SEQ ID NO: 6298

SEQ ID NO: 18276 - protein, 826 aa, Escherichia coli O104:H4 str. 11-4522; identical to SEQ ID NO: 6301

SEQ ID NO: 18277 - protein, 224 aa, Escherichia coli O104:H4 str. 11-4522; identical to SEQ ID NO: 6302

SEQ ID NO: 18278 - protein, 663 aa, Escherichia coli O104:H4 str. 11-4522; identical to SEQ ID NO: 6307

SEQ ID NO: 18279 - protein, 828 aa, Escherichia coli O104:H4 str. 11-4522; identical to SEQ ID NO: 6308

SEQ ID NO: 18280 - protein, 162 aa, Escherichia coli O104:H4 str. 11-4522; identical to SEQ ID NO: 5896

SEQ ID NO: 18281 - protein, 367 aa, Escherichia coli O104:H4 str. 11-4522; identical to SEQ ID NO: 6310

SEQ ID NO: 18282 - protein, 200 aa, Escherichia coli O104:H4 str. 11-4522; identical to SEQ ID NO: 6311

SEQ ID NO: 18283 - protein, 274 aa, Escherichia coli O104:H4 str. 11-4522; identical to SEQ ID NO: 6316

SEQ ID NO: 18284 - protein, 250 aa, Escherichia coli O104:H4 str. 11-4522; identical to SEQ ID NO: 6317

SEQ ID NO: 18285 - protein, 880 aa, Escherichia coli O104:H4 str. 11-4522; identical to SEQ ID NO: 18185

SEQ ID NO: 18286 - protein, 518 aa, Escherichia coli O104:H4 str. 11-4522; identical to SEQ ID NO: 6358

SEQ ID NO: 18287 - protein, 432 aa, Escherichia coli O104:H4 str. 11-4522; identical to SEQ ID NO: 5727

SEQ ID NO: 18288 - protein, 359 aa, Escherichia coli O104:H4 str. 11-4522; identical to SEQ ID NO: 6332

SEQ ID NO: 18289 - protein, 686 aa, Escherichia coli O104:H4 str. 11-4522; identical to SEQ ID NO: 6339

SEQ ID NO: 18290 - protein, 837 aa, Escherichia coli O104:H4 str. 11-4522; identical to SEQ ID NO: 6340

SEQ ID NO: 18291 - protein, 249 aa, Escherichia coli O104:H4 str. 11-4522; identical to SEQ ID NO: 6350

SEQ ID NO: 18292 - protein, 231 aa, Escherichia coli O104:H4 str. 11-4522; identical to SEQ ID NO: 6351

SEQ ID NO: 18293 - protein, 838 aa, Escherichia coli O104:H4 str. 11-4522; identical to SEQ ID NO: 6352

SEQ ID NO: 18294 - protein, 678 aa, Escherichia coli O104:H4 str. 11-4522; identical to SEQ ID NO: 6353

SEQ ID NO: 18295 - protein, 402 aa, Escherichia coli O104:H4 str. 11-4522; identical to SEQ ID NO: 18029

SEQ ID NO: 18296 - protein, 843 aa, Escherichia coli O104:H4 str. 11-4522; identical to SEQ ID NO: 6288

SEQ ID NO: 18297 - protein, 228 aa, Escherichia coli O104:H4 str. 11-4522; identical to SEQ ID NO: 6185

SEQ ID NO: 18298 - protein, 243 aa, Escherichia coli O104:H4 str. 11-4522; identical to SEQ ID NO: 6145

SEQ ID NO: 18299 - protein, 208 aa, Escherichia coli O104:H4 str. 11-4522; identical to SEQ ID NO: 5717

SEQ ID NO: 18300 - protein, 614 aa, Escherichia coli O104:H4 str. 11-4522; identical to SEQ ID NO: 6303

SEQ ID NO: 18301 - protein, 446 aa, Escherichia coli O104:H4 str. 11-4522; identical to SEQ ID NO: 6312

SEQ ID NO: 18302 - protein, 237 aa, Escherichia coli O104:H4 str. 11-4522; identical to SEQ ID NO: 6313

SEQ ID NO: 18303 - protein, 478 aa, Escherichia coli O104:H4 str. 11-4522; identical to SEQ ID NO: 5711

SEQ ID NO: 18304 - protein, 732 aa, Escherichia coli O104:H4 str. 11-4522; identical to SEQ ID NO: 18038

SEQ ID NO: 18305 - protein, 774 aa, Escherichia coli O104:H4 str. 11-4522; identical to SEQ ID NO: 18137

SEQ ID NO: 18306 - protein, 784 aa, Escherichia coli O104:H4 str. 11-4522; identical to SEQ ID NO: 6283

SEQ ID NO: 18307 - protein, 866 aa, Escherichia coli O104:H4 str. 11-4522; identical to SEQ ID NO: 17928

SEQ ID NO: 18308 - protein, 246 aa, Escherichia coli O104:H4 str. 11-4522; identical to SEQ ID NO: 6342

SEQ ID NO: 18309 - protein, 747 aa, Escherichia coli O104:H4 str. 11-4522; identical to SEQ ID NO: 6343

SEQ ID NO: 18310 - protein, 266 aa, Escherichia coli O104:H4 str. 11-4522; identical to SEQ ID NO: 5772

SEQ ID NO: 18311 - protein, 161 aa, Escherichia coli O104:H4 str. 11-4522; identical to SEQ ID NO: 5769

SEQ ID NO: 18312 - protein, 351 aa, Escherichia coli O104:H4 str. 11-4522; identical to SEQ ID NO: 6282

SEQ ID NO: 18313 - protein, 230 aa, Escherichia coli O104:H4 str. 11-4522; identical to SEQ ID NO: 6294

SEQ ID NO: 18314 - protein, 869 aa, Escherichia coli O104:H4 str. 11-4522; identical to SEQ ID NO: 17935

SEQ ID NO: 18315 - protein, 746 aa, Escherichia coli O104:H4 str. 11-4522; identical to SEQ ID NO: 6296

SEQ ID NO: 18316 - protein, 193 aa, Escherichia coli O104:H4 str. 11-4522; identical to SEQ ID NO: 6300

SEQ ID NO: 18317 - protein, 430 aa, Escherichia coli O104:H4 str. 11-4522; identical to SEQ ID NO: 5758

SEQ ID NO: 18318 - protein, 360 aa, Escherichia coli O104:H4 str. 11-4522; identical to SEQ ID NO: 6315

SEQ ID NO: 18319 - protein, 331 aa, Escherichia coli O104:H4 str. 11-4522; identical to SEQ ID NO: 6456

SEQ ID NO: 18320 - protein, 760 aa, Escherichia coli O104:H4 str. 11-4522; identical to SEQ ID NO: 6322

SEQ ID NO: 18321 - protein, 203 aa, Escherichia coli O104:H4 str. 11-4522; identical to SEQ ID NO: 6414

SEQ ID NO: 18322 - protein, 362 aa, Escherichia coli O104:H4 str. 11-4522; identical to SEQ ID NO: 5809

SEQ ID NO: 18323 - protein, 233 aa, Escherichia coli O104:H4 str. 11-4522; identical to SEQ ID NO: 6327

SEQ ID NO: 18324 - protein, 866 aa, Escherichia coli O104:H4 str. 11-4522; identical to SEQ ID NO: 6328

SEQ ID NO: 18325 - protein, 229 aa, Escherichia coli O104:H4 str. 11-4522; identical to SEQ ID NO: 9369

SEQ ID NO: 18326 - protein, 89 aa, Escherichia coli O104:H4 str. 11-4522; identical to SEQ ID NO: 6233

SEQ ID NO: 18327 - protein, 696 aa, Escherichia coli O104:H4 str. 11-4522; identical to SEQ ID NO: 12728

SEQ ID NO: 18328 - protein, 203 aa, Escherichia coli O104:H4 str. 11-4522; identical to SEQ ID NO: 6347

SEQ ID NO: 18329 - protein, 565 aa, Escherichia coli O104:H4 str. 11-4522; identical to SEQ ID NO: 6395

SEQ ID NO: 18330 - protein, 207 aa, Escherichia coli O104:H4 str. 11-4522; identical to SEQ ID NO: 5743

SEQ ID NO: 18331 - protein, 191 aa, Escherichia coli O104:H4 str. 11-4522; identical to SEQ ID NO: 5748

SEQ ID NO: 18332 - protein, 232 aa, Escherichia coli O104:H4 str. 11-4522; identical to SEQ ID NO: 5747

SEQ ID NO: 18333 - protein, 729 aa, Escherichia coli O104:H4 str. 11-4522; identical to SEQ ID NO: 6336

SEQ ID NO: 18334 - protein, 213 aa, Escherichia coli O104:H4 str. 11-4522; identical to SEQ ID NO: 5744

SEQ ID NO: 18335 - protein, 539 aa, Escherichia coli O104:H4 str. 11-4522; identical to SEQ ID NO: 6525

SEQ ID NO: 18336 - protein, 700 aa, Escherichia coli O104:H4 str. 11-4522; identical to SEQ ID NO: 6287

SEQ ID NO: 18337 - protein, 883 aa, Escherichia coli O104:H4 str. 11-4522; identical to SEQ ID NO: 18005

SEQ ID NO: 18338 - protein, 236 aa, Escherichia coli O104:H4 str. 11-4522; identical to SEQ ID NO: 6472

SEQ ID NO: 18339 - protein, 209 aa, Escherichia coli O104:H4 str. 11-4522; identical to SEQ ID NO: 18271

SEQ ID NO: 18340 - protein, 794 aa, Escherichia coli O104:H4 str. 11-4522; identical to SEQ ID NO: 18204

SEQ ID NO: 18341 - protein, 696 aa, Escherichia coli O104:H4 str. 11-4623; identical to SEQ ID NO: 12728

SEQ ID NO: 18342 - protein, 191 aa, Escherichia coli O104:H4 str. 11-4623; identical to SEQ ID NO: 5748

SEQ ID NO: 18343 - protein, 232 aa, Escherichia coli O104:H4 str. 11-4623; identical to SEQ ID NO: 5747

SEQ ID NO: 18344 - protein, 729 aa, Escherichia coli O104:H4 str. 11-4623; identical to SEQ ID NO: 6336

SEQ ID NO: 18345 - protein, 213 aa, Escherichia coli O104:H4 str. 11-4623; identical to SEQ ID NO: 5744

SEQ ID NO: 18346 - protein, 203 aa, Escherichia coli O104:H4 str. 11-4623; identical to SEQ ID NO: 6347

SEQ ID NO: 18347 - protein, 565 aa, Escherichia coli O104:H4 str. 11-4623; identical to SEQ ID NO: 6395

SEQ ID NO: 18348 - protein, 207 aa, Escherichia coli O104:H4 str. 11-4623; identical to SEQ ID NO: 5743

SEQ ID NO: 18349 - protein, 539 aa, Escherichia coli O104:H4 str. 11-4623; identical to SEQ ID NO: 6525

SEQ ID NO: 18350 - protein, 700 aa, Escherichia coli O104:H4 str. 11-4623; identical to SEQ ID NO: 6287

SEQ ID NO: 18351 - protein, 883 aa, Escherichia coli O104:H4 str. 11-4623; identical to SEQ ID NO: 18005

SEQ ID NO: 18352 - protein, 236 aa, Escherichia coli O104:H4 str. 11-4623; identical to SEQ ID NO: 6472

SEQ ID NO: 18353 - protein, 102 aa, Escherichia coli O104:H4 str. 11-4623; identical to SEQ ID NO: 6285

SEQ ID NO: 18354 - protein, 118 aa, Escherichia coli O104:H4 str. 11-4623 [sequence omitted]

SEQ ID NO: 18355 - protein, 673 aa, Escherichia coli O104:H4 str. 11-4623; identical to SEQ ID NO: 6298

SEQ ID NO: 18356 - protein, 274 aa, Escherichia coli O104:H4 str. 11-4623; identical to SEQ ID NO: 6316

SEQ ID NO: 18357 - protein, 250 aa, Escherichia coli O104:H4 str. 11-4623; identical to SEQ ID NO: 6317

SEQ ID NO: 18358 - protein, 880 aa, Escherichia coli O104:H4 str. 11-4623; identical to SEQ ID NO: 18185

SEQ ID NO: 18359 - protein, 826 aa, Escherichia coli O104:H4 str. 11-4623; identical to SEQ ID NO: 6301

SEQ ID NO: 18360 - protein, 224 aa, Escherichia coli O104:H4 str. 11-4623; identical to SEQ ID NO: 6302

SEQ ID NO: 18361 - protein, 663 aa, Escherichia coli O104:H4 str. 11-4623; identical to SEQ ID NO: 6307

SEQ ID NO: 18362 - protein, 828 aa, Escherichia coli O104:H4 str. 11-4623; identical to SEQ ID NO: 6308

SEQ ID NO: 18363 - protein, 162 aa, Escherichia coli O104:H4 str. 11-4623; identical to SEQ ID NO: 5896

SEQ ID NO: 18364 - protein, 367 aa, Escherichia coli O104:H4 str. 11-4623; identical to SEQ ID NO: 6310

SEQ ID NO: 18365 - protein, 200 aa, Escherichia coli O104:H4 str. 11-4623; identical to SEQ ID NO: 6311

SEQ ID NO: 18366 - protein, 518 aa, Escherichia coli O104:H4 str. 11-4623; identical to SEQ ID NO: 6358

SEQ ID NO: 18367 - protein, 359 aa, Escherichia coli O104:H4 str. 11-4623; identical to SEQ ID NO: 6332

SEQ ID NO: 18368 - protein, 432 aa, Escherichia coli O104:H4 str. 11-4623; identical to SEQ ID NO: 5727

SEQ ID NO: 18369 - protein, 686 aa, Escherichia coli O104:H4 str. 11-4623; identical to SEQ ID NO: 6339

SEQ ID NO: 18370 - protein, 837 aa, Escherichia coli O104:H4 str. 11-4623; identical to SEQ ID NO: 6340

SEQ ID NO: 18371 - protein, 249 aa, Escherichia coli O104:H4 str. 11-4623; identical to SEQ ID NO: 6350

SEQ ID NO: 18372 - protein, 231 aa, Escherichia coli O104:H4 str. 11-4623; identical to SEQ ID NO: 6351

SEQ ID NO: 18373 - protein, 838 aa, Escherichia coli O104:H4 str. 11-4623; identical to SEQ ID NO: 6352

SEQ ID NO: 18374 - protein, 678 aa, Escherichia coli O104:H4 str. 11-4623; identical to SEQ ID NO: 6353

SEQ ID NO: 18375 - protein, 402 aa, Escherichia coli O104:H4 str. 11-4623; identical to SEQ ID NO: 18029

SEQ ID NO: 18376 - protein, 843 aa, Escherichia coli O104:H4 str. 11-4623; identical to SEQ ID NO: 6288

SEQ ID NO: 18377 - protein, 228 aa, Escherichia coli O104:H4 str. 11-4623; identical to SEQ ID NO: 6185

SEQ ID NO: 18378 - protein, 243 aa, Escherichia coli O104:H4 str. 11-4623; identical to SEQ ID NO: 6145

SEQ ID NO: 18379 - protein, 208 aa, Escherichia coli O104:H4 str. 11-4623; identical to SEQ ID NO: 5717

SEQ ID NO: 18380 - protein, 614 aa, Escherichia coli O104:H4 str. 11-4623; identical to SEQ ID NO: 6303

SEQ ID NO: 18381 - protein, 237 aa, Escherichia coli O104:H4 str. 11-4623; identical to SEQ ID NO: 6313

SEQ ID NO: 18382 - protein, 478 aa, Escherichia coli O104:H4 str. 11-4623; identical to SEQ ID NO: 5711

SEQ ID NO: 18383 - protein, 446 aa, Escherichia coli O104:H4 str. 11-4623; identical to SEQ ID NO: 6312

SEQ ID NO: 18384 - protein, 732 aa, Escherichia coli O104:H4 str. 11-4623; identical to SEQ ID NO: 18038

SEQ ID NO: 18385 - protein, 774 aa, Escherichia coli O104:H4 str. 11-4623; identical to SEQ ID NO: 18137

SEQ ID NO: 18386 - protein, 784 aa, Escherichia coli O104:H4 str. 11-4623; identical to SEQ ID NO: 6283

SEQ ID NO: 18387 - protein, 866 aa, Escherichia coli O104:H4 str. 11-4623; identical to SEQ ID NO: 17928

SEQ ID NO: 18388 - protein, 246 aa, Escherichia coli O104:H4 str. 11-4623; identical to SEQ ID NO: 6342

SEQ ID NO: 18389 - protein, 747 aa, Escherichia coli O104:H4 str. 11-4623; identical to SEQ ID NO: 6343

SEQ ID NO: 18390 - protein, 266 aa, Escherichia coli O104:H4 str. 11-4623; identical to SEQ ID NO: 5772

SEQ ID NO: 18391 - protein, 161 aa, Escherichia coli O104:H4 str. 11-4623; identical to SEQ ID NO: 5769

SEQ ID NO: 18392 - protein, 230 aa, Escherichia coli O104:H4 str. 11-4623; identical to SEQ ID NO: 6294

SEQ ID NO: 18393 - protein, 869 aa, Escherichia coli O104:H4 str. 11-4623; identical to SEQ ID NO: 17935

SEQ ID NO: 18394 - protein, 351 aa, Escherichia coli O104:H4 str. 11-4623; identical to SEQ ID NO: 6282

SEQ ID NO: 18395 - protein, 746 aa, Escherichia coli O104:H4 str. 11-4623; identical to SEQ ID NO: 6296

SEQ ID NO: 18396 - protein, 193 aa, Escherichia coli O104:H4 str. 11-4623; identical to SEQ ID NO: 6300

SEQ ID NO: 18397 - protein, 430 aa, Escherichia coli O104:H4 str. 11-4623; identical to SEQ ID NO: 5758

SEQ ID NO: 18398 - protein, 360 aa, Escherichia coli O104:H4 str. 11-4623; identical to SEQ ID NO: 6315

SEQ ID NO: 18399 - protein, 331 aa, Escherichia coli O104:H4 str. 11-4623; identical to SEQ ID NO: 6456

SEQ ID NO: 18400 - protein, 760 aa, Escherichia coli O104:H4 str. 11-4623; identical to SEQ ID NO: 6322

SEQ ID NO: 18401 - protein, 203 aa, Escherichia coli O104:H4 str. 11-4623; identical to SEQ ID NO: 6414

SEQ ID NO: 18402 - protein, 362 aa, Escherichia coli O104:H4 str. 11-4623; identical to SEQ ID NO: 5809

SEQ ID NO: 18403 - protein, 233 aa, Escherichia coli O104:H4 str. 11-4623; identical to SEQ ID NO: 6327

SEQ ID NO: 18404 - protein, 866 aa, Escherichia coli O104:H4 str. 11-4623; identical to SEQ ID NO: 6328

SEQ ID NO: 18405 - protein, 229 aa, Escherichia coli O104:H4 str. 11-4623; identical to SEQ ID NO: 9369

SEQ ID NO: 18406 - protein, 89 aa, Escherichia coli O104:H4 str. 11-4623; identical to SEQ ID NO: 6233

SEQ ID NO: 18407 - protein, 198 aa, Escherichia coli O104:H4 str. 11-4623; identical to SEQ ID NO: 18203

SEQ ID NO: 18408 - protein, 794 aa, Escherichia coli O104:H4 str. 11-4623; identical to SEQ ID NO: 18204

SEQ ID NO: 18409 - protein, 686 aa, Escherichia coli O104:H4 str. 11-4632 C1; identical to SEQ ID NO: 6339

SEQ ID NO: 18410 - protein, 834 aa, Escherichia coli O104:H4 str. 11-4632 C1; identical to SEQ ID NO: 17975

SEQ ID NO: 18411 - protein, 249 aa, Escherichia coli O104:H4 str. 11-4632 C1; identical to SEQ ID NO: 6350

SEQ ID NO: 18412 - protein, 231 aa, Escherichia coli O104:H4 str. 11-4632 C1; identical to SEQ ID NO: 6351

SEQ ID NO: 18413 - protein, 838 aa, Escherichia coli O104:H4 str. 11-4632 C1; identical to SEQ ID NO: 6352

SEQ ID NO: 18414 - protein, 678 aa, Escherichia coli O104:H4 str. 11-4632 C1; identical to SEQ ID NO: 6353

SEQ ID NO: 18415 - protein, 402 aa, Escherichia coli O104:H4 str. 11-4632 C1; identical to SEQ ID NO: 18029

SEQ ID NO: 18416 - protein, 843 aa, Escherichia coli O104:H4 str. 11-4632 C1; identical to SEQ ID NO: 6288

SEQ ID NO: 18417 - protein, 228 aa, Escherichia coli O104:H4 str. 11-4632 C1; identical to SEQ ID NO: 6185

SEQ ID NO: 18418 - protein, 243 aa, Escherichia coli O104:H4 str. 11-4632 C1; identical to SEQ ID NO: 6145

SEQ ID NO: 18419 - protein, 614 aa, Escherichia coli O104:H4 str. 11-4632 C1; identical to SEQ ID NO: 6303

SEQ ID NO: 18420 - protein, 208 aa, Escherichia coli O104:H4 str. 11-4632 C1; identical to SEQ ID NO: 5717

SEQ ID NO: 18421 - protein, 446 aa, Escherichia coli O104:H4 str. 11-4632 C1; identical to SEQ ID NO: 6312

SEQ ID NO: 18422 - protein, 237 aa, Escherichia coli O104:H4 str. 11-4632 C1; identical to SEQ ID NO: 6313

SEQ ID NO: 18423 - protein, 478 aa, Escherichia coli O104:H4 str. 11-4632 C1; identical to SEQ ID NO: 5711

SEQ ID NO: 18424 - protein, 732 aa, Escherichia coli O104:H4 str. 11-4632 C1; identical to SEQ ID NO: 18038

SEQ ID NO: 18425 - protein, 774 aa, Escherichia coli O104:H4 str. 11-4632 C1; identical to SEQ ID NO: 18137

SEQ ID NO: 18426 - protein, 784 aa, Escherichia coli O104:H4 str. 11-4632 C1; identical to SEQ ID NO: 6283

SEQ ID NO: 18427 - protein, 866 aa, Escherichia coli O104:H4 str. 11-4632 C1; identical to SEQ ID NO: 17928

SEQ ID NO: 18428 - protein, 246 aa, Escherichia coli O104:H4 str. 11-4632 C1; identical to SEQ ID NO: 6342

SEQ ID NO: 18429 - protein, 747 aa, Escherichia coli O104:H4 str. 11-4632 C1; identical to SEQ ID NO: 6343

SEQ ID NO: 18430 - protein, 266 aa, Escherichia coli O104:H4 str. 11-4632 C1; identical to SEQ ID NO: 5772

SEQ ID NO: 18431 - protein, 161 aa, Escherichia coli O104:H4 str. 11-4632 C1; identical to SEQ ID NO: 5769

SEQ ID NO: 18432 - protein, 230 aa, Escherichia coli O104:H4 str. 11-4632 C1; identical to SEQ ID NO: 6294

SEQ ID NO: 18433 - protein, 869 aa, Escherichia coli O104:H4 str. 11-4632 C1; identical to SEQ ID NO: 17935

SEQ ID NO: 18434 - protein, 746 aa, Escherichia coli O104:H4 str. 11-4632 C1; identical to SEQ ID NO: 6296

SEQ ID NO: 18435 - protein, 193 aa, Escherichia coli O104:H4 str. 11-4632 C1; identical to SEQ ID NO: 6300

SEQ ID NO: 18436 - protein, 351 aa, Escherichia coli O104:H4 str. 11-4632 C1; identical to SEQ ID NO: 6282

SEQ ID NO: 18437 - protein, 203 aa, Escherichia coli O104:H4 str. 11-4632 C1; identical to SEQ ID NO: 6414

SEQ ID NO: 18438 - protein, 362 aa, Escherichia coli O104:H4 str. 11-4632 C1; identical to SEQ ID NO: 5809

SEQ ID NO: 18439 - protein, 233 aa, Escherichia coli O104:H4 str. 11-4632 C1; identical to SEQ ID NO: 6327

SEQ ID NO: 18440 - protein, 866 aa, Escherichia coli O104:H4 str. 11-4632 C1; identical to SEQ ID NO: 6328

SEQ ID NO: 18441 - protein, 229 aa, Escherichia coli O104:H4 str. 11-4632 C1; identical to SEQ ID NO: 9369

SEQ ID NO: 18442 - protein, 89 aa, Escherichia coli O104:H4 str. 11-4632 C1; identical to SEQ ID NO: 6233

SEQ ID NO: 18443 - protein, 430 aa, Escherichia coli O104:H4 str. 11-4632 C1; identical to SEQ ID NO: 5758

SEQ ID NO: 18444 - protein, 360 aa, Escherichia coli O104:H4 str. 11-4632 C1; identical to SEQ ID NO: 6315

SEQ ID NO: 18445 - protein, 331 aa, Escherichia coli O104:H4 str. 11-4632 C1; identical to SEQ ID NO: 6456

SEQ ID NO: 18446 - protein, 760 aa, Escherichia coli O104:H4 str. 11-4632 C1; identical to SEQ ID NO: 6322

SEQ ID NO: 18447 - protein, 696 aa, Escherichia coli O104:H4 str. 11-4632 C1; identical to SEQ ID NO: 12728

SEQ ID NO: 18448 - protein, 191 aa, Escherichia coli O104:H4 str. 11-4632 C1; identical to SEQ ID NO: 5748

SEQ ID NO: 18449 - protein, 232 aa, Escherichia coli O104:H4 str. 11-4632 C1; identical to SEQ ID NO: 5747

SEQ ID NO: 18450 - protein, 729 aa, Escherichia coli O104:H4 str. 11-4632 C1; identical to SEQ ID NO: 6336

SEQ ID NO: 18451 - protein, 213 aa, Escherichia coli O104:H4 str. 11-4632 C1; identical to SEQ ID NO: 5744

SEQ ID NO: 18452 - protein, 203 aa, Escherichia coli O104:H4 str. 11-4632 C1; identical to SEQ ID NO: 6347

SEQ ID NO: 18453 - protein, 565 aa, Escherichia coli O104:H4 str. 11-4632 C1; identical to SEQ ID NO: 6395

SEQ ID NO: 18454 - protein, 207 aa, Escherichia coli O104:H4 str. 11-4632 C1; identical to SEQ ID NO: 5743

SEQ ID NO: 18455 - protein, 539 aa, Escherichia coli O104:H4 str. 11-4632 C1; identical to SEQ ID NO: 6525

SEQ ID NO: 18456 - protein, 700 aa, Escherichia coli O104:H4 str. 11-4632 C1; identical to SEQ ID NO: 6287

SEQ ID NO: 18457 - protein, 883 aa, Escherichia coli O104:H4 str. 11-4632 C1; identical to SEQ ID NO: 18005

SEQ ID NO: 18458 - protein, 236 aa, Escherichia coli O104:H4 str. 11-4632 C1; identical to SEQ ID NO: 6472

SEQ ID NO: 18459 - protein, 102 aa, Escherichia coli O104:H4 str. 11-4632 C1; identical to SEQ ID NO: 6285

SEQ ID NO: 18460 - protein, 118 aa, Escherichia coli O104:H4 str. 11-4632 C1 [sequence omitted]

SEQ ID NO: 18461 - protein, 673 aa, Escherichia coli O104:H4 str. 11-4632 C1; identical to SEQ ID NO: 6298

SEQ ID NO: 18462 - protein, 274 aa, Escherichia coli O104:H4 str. 11-4632 C1; identical to SEQ ID NO: 6316

SEQ ID NO: 18463 - protein, 250 aa, Escherichia coli O104:H4 str. 11-4632 C1; identical to SEQ ID NO: 6317

SEQ ID NO: 18464 - protein, 880 aa, Escherichia coli O104:H4 str. 11-4632 C1; identical to SEQ ID NO: 18185

SEQ ID NO: 18465 - protein, 826 aa, Escherichia coli O104:H4 str. 11-4632 C1; identical to SEQ ID NO: 6301

SEQ ID NO: 18466 - protein, 224 aa, Escherichia coli O104:H4 str. 11-4632 C1; identical to SEQ ID NO: 6302

SEQ ID NO: 18467 - protein, 663 aa, Escherichia coli O104:H4 str. 11-4632 C1; identical to SEQ ID NO: 6307

SEQ ID NO: 18468 - protein, 828 aa, Escherichia coli O104:H4 str. 11-4632 C1; identical to SEQ ID NO: 6308

SEQ ID NO: 18469 - protein, 162 aa, Escherichia coli O104:H4 str. 11-4632 C1; identical to SEQ ID NO: 5896

SEQ ID NO: 18470 - protein, 367 aa, Escherichia coli O104:H4 str. 11-4632 C1; identical to SEQ ID NO: 6310

SEQ ID NO: 18471 - protein, 200 aa, Escherichia coli O104:H4 str. 11-4632 C1; identical to SEQ ID NO: 6311

SEQ ID NO: 18472 - protein, 518 aa, Escherichia coli O104:H4 str. 11-4632 C1; identical to SEQ ID NO: 6358

SEQ ID NO: 18473 - protein, 359 aa, Escherichia coli O104:H4 str. 11-4632 C1; identical to SEQ ID NO: 6332

SEQ ID NO: 18474 - protein, 432 aa, Escherichia coli O104:H4 str. 11-4632 C1; identical to SEQ ID NO: 5727

SEQ ID NO: 18475 - protein, 209 aa, Escherichia coli O104:H4 str. 11-4632 C1; identical to SEQ ID NO: 18271

SEQ ID NO: 18476 - protein, 794 aa, Escherichia coli O104:H4 str. 11-4632 C1; identical to SEQ ID NO: 18204

SEQ ID NO: 18477 - protein, 231 aa, Escherichia coli O104:H4 str. 11-4632 C2; identical to SEQ ID NO: 6351

SEQ ID NO: 18478 - protein, 838 aa, Escherichia coli O104:H4 str. 11-4632 C2; identical to SEQ ID NO: 6352

SEQ ID NO: 18479 - protein, 678 aa, Escherichia coli O104:H4 str. 11-4632 C2; identical to SEQ ID NO: 6353

SEQ ID NO: 18480 - protein, 686 aa, Escherichia coli O104:H4 str. 11-4632 C2; identical to SEQ ID NO: 6339

SEQ ID NO: 18481 - protein, 837 aa, Escherichia coli O104:H4 str. 11-4632 C2; identical to SEQ ID NO: 6340

SEQ ID NO: 18482 - protein, 249 aa, Escherichia coli O104:H4 str. 11-4632 C2; identical to SEQ ID NO: 6350

SEQ ID NO: 18483 - protein, 402 aa, Escherichia coli O104:H4 str. 11-4632 C2; identical to SEQ ID NO: 18029

SEQ ID NO: 18484 - protein, 843 aa, Escherichia coli O104:H4 str. 11-4632 C2; identical to SEQ ID NO: 6288

SEQ ID NO: 18485 - protein, 228 aa, Escherichia coli O104:H4 str. 11-4632 C2; identical to SEQ ID NO: 6185

SEQ ID NO: 18486 - protein, 243 aa, Escherichia coli O104:H4 str. 11-4632 C2; identical to SEQ ID NO: 6145

SEQ ID NO: 18487 - protein, 614 aa, Escherichia coli O104:H4 str. 11-4632 C2; identical to SEQ ID NO: 6303

SEQ ID NO: 18488 - protein, 208 aa, Escherichia coli O104:H4 str. 11-4632 C2; identical to SEQ ID NO: 5717

SEQ ID NO: 18489 - protein, 446 aa, Escherichia coli O104:H4 str. 11-4632 C2; identical to SEQ ID NO: 6312

SEQ ID NO: 18490 - protein, 237 aa, Escherichia coli O104:H4 str. 11-4632 C2; identical to SEQ ID NO: 6313

SEQ ID NO: 18491 - protein, 478 aa, Escherichia coli O104:H4 str. 11-4632 C2; identical to SEQ ID NO: 5711

SEQ ID NO: 18492 - protein, 732 aa, Escherichia coli O104:H4 str. 11-4632 C2; identical to SEQ ID NO: 18038

SEQ ID NO: 18493 - protein, 866 aa, Escherichia coli O104:H4 str. 11-4632 C2; identical to SEQ ID NO: 17928

SEQ ID NO: 18494 - protein, 246 aa, Escherichia coli O104:H4 str. 11-4632 C2; identical to SEQ ID NO: 6342

SEQ ID NO: 18495 - protein, 747 aa, Escherichia coli O104:H4 str. 11-4632 C2; identical to SEQ ID NO: 6343

SEQ ID NO: 18496 - protein, 266 aa, Escherichia coli O104:H4 str. 11-4632 C2; identical to SEQ ID NO: 5772

SEQ ID NO: 18497 - protein, 161 aa, Escherichia coli O104:H4 str. 11-4632 C2; identical to SEQ ID NO: 5769

SEQ ID NO: 18498 - protein, 351 aa, Escherichia coli O104:H4 str. 11-4632 C2; identical to SEQ ID NO: 6282

SEQ ID NO: 18499 - protein, 774 aa, Escherichia coli O104:H4 str. 11-4632 C2; identical to SEQ ID NO: 18137

SEQ ID NO: 18500 - protein, 784 aa, Escherichia coli O104:H4 str. 11-4632 C2; identical to SEQ ID NO: 6283

SEQ ID NO: 18501 - protein, 230 aa, Escherichia coli O104:H4 str. 11-4632 C2; identical to SEQ ID NO: 6294

SEQ ID NO: 18502 - protein, 869 aa, Escherichia coli O104:H4 str. 11-4632 C2; identical to SEQ ID NO: 17935

SEQ ID NO: 18503 - protein, 746 aa, Escherichia coli O104:H4 str. 11-4632 C2; identical to SEQ ID NO: 6296

SEQ ID NO: 18504 - protein, 193 aa, Escherichia coli O104:H4 str. 11-4632 C2; identical to SEQ ID NO: 6300

SEQ ID NO: 18505 - protein, 430 aa, Escherichia coli O104:H4 str. 11-4632 C2; identical to SEQ ID NO: 5758

SEQ ID NO: 18506 - protein, 362 aa, Escherichia coli O104:H4 str. 11-4632 C2; identical to SEQ ID NO: 5809

SEQ ID NO: 18507 - protein, 233 aa, Escherichia coli O104:H4 str. 11-4632 C2; identical to SEQ ID NO: 6327

SEQ ID NO: 18508 - protein, 866 aa, Escherichia coli O104:H4 str. 11-4632 C2; identical to SEQ ID NO: 6328

SEQ ID NO: 18509 - protein, 229 aa, Escherichia coli O104:H4 str. 11-4632 C2; identical to SEQ ID NO: 9369

SEQ ID NO: 18510 - protein, 360 aa, Escherichia coli O104:H4 str. 11-4632 C2; identical to SEQ ID NO: 6315

SEQ ID NO: 18511 - protein, 331 aa, Escherichia coli O104:H4 str. 11-4632 C2; identical to SEQ ID NO: 6456

SEQ ID NO: 18512 - protein, 760 aa, Escherichia coli O104:H4 str. 11-4632 C2; identical to SEQ ID NO: 6322

SEQ ID NO: 18513 - protein, 203 aa, Escherichia coli O104:H4 str. 11-4632 C2; identical to SEQ ID NO: 6414

SEQ ID NO: 18514 - protein, 89 aa, Escherichia coli O104:H4 str. 11-4632 C2; identical to SEQ ID NO: 6233

SEQ ID NO: 18515 - protein, 696 aa, Escherichia coli O104:H4 str. 11-4632 C2; identical to SEQ ID NO: 12728

SEQ ID NO: 18516 - protein, 191 aa, Escherichia coli O104:H4 str. 11-4632 C2; identical to SEQ ID NO: 5748

SEQ ID NO: 18517 - protein, 232 aa, Escherichia coli O104:H4 str. 11-4632 C2; identical to SEQ ID NO: 5747

SEQ ID NO: 18518 - protein, 729 aa, Escherichia coli O104:H4 str. 11-4632 C2; identical to SEQ ID NO: 6336

SEQ ID NO: 18519 - protein, 213 aa, Escherichia coli O104:H4 str. 11-4632 C2; identical to SEQ ID NO: 5744

SEQ ID NO: 18520 - protein, 203 aa, Escherichia coli O104:H4 str. 11-4632 C2; identical to SEQ ID NO: 6347

SEQ ID NO: 18521 - protein, 565 aa, Escherichia coli O104:H4 str. 11-4632 C2; identical to SEQ ID NO: 6395

SEQ ID NO: 18522 - protein, 207 aa, Escherichia coli O104:H4 str. 11-4632 C2; identical to SEQ ID NO: 5743

SEQ ID NO: 18523 - protein, 539 aa, Escherichia coli O104:H4 str. 11-4632 C2; identical to SEQ ID NO: 6525

SEQ ID NO: 18524 - protein, 700 aa, Escherichia coli O104:H4 str. 11-4632 C2; identical to SEQ ID NO: 6287

SEQ ID NO: 18525 - protein, 883 aa, Escherichia coli O104:H4 str. 11-4632 C2; identical to SEQ ID NO: 18005

SEQ ID NO: 18526 - protein, 236 aa, Escherichia coli O104:H4 str. 11-4632 C2; identical to SEQ ID NO: 6472

SEQ ID NO: 18527 - protein, 102 aa, Escherichia coli O104:H4 str. 11-4632 C2; identical to SEQ ID NO: 6285

SEQ ID NO: 18528 - protein, 118 aa, Escherichia coli O104:H4 str. 11-4632 C2 [sequence omitted]

SEQ ID NO: 18529 - protein, 673 aa, Escherichia coli O104:H4 str. 11-4632 C2; identical to SEQ ID NO: 6298

SEQ ID NO: 18530 - protein, 663 aa, Escherichia coli O104:H4 str. 11-4632 C2; identical to SEQ ID NO: 6307

SEQ ID NO: 18531 - protein, 828 aa, Escherichia coli O104:H4 str. 11-4632 C2; identical to SEQ ID NO: 6308

SEQ ID NO: 18532 - protein, 162 aa, Escherichia coli O104:H4 str. 11-4632 C2; identical to SEQ ID NO: 5896

SEQ ID NO: 18533 - protein, 367 aa, Escherichia coli O104:H4 str. 11-4632 C2; identical to SEQ ID NO: 6310

SEQ ID NO: 18534 - protein, 200 aa, Escherichia coli O104:H4 str. 11-4632 C2; identical to SEQ ID NO: 6311

SEQ ID NO: 18535 - protein, 274 aa, Escherichia coli O104:H4 str. 11-4632 C2; identical to SEQ ID NO: 6316

SEQ ID NO: 18536 - protein, 250 aa, Escherichia coli O104:H4 str. 11-4632 C2; identical to SEQ ID NO: 6317

SEQ ID NO: 18537 - protein, 880 aa, Escherichia coli O104:H4 str. 11-4632 C2; identical to SEQ ID NO: 18185

SEQ ID NO: 18538 - protein, 826 aa, Escherichia coli O104:H4 str. 11-4632 C2; identical to SEQ ID NO: 6301

SEQ ID NO: 18539 - protein, 224 aa, Escherichia coli O104:H4 str. 11-4632 C2; identical to SEQ ID NO: 6302

SEQ ID NO: 18540 - protein, 518 aa, Escherichia coli O104:H4 str. 11-4632 C2; identical to SEQ ID NO: 6358

SEQ ID NO: 18541 - protein, 359 aa, Escherichia coli O104:H4 str. 11-4632 C2; identical to SEQ ID NO: 6332

SEQ ID NO: 18542 - protein, 432 aa, Escherichia coli O104:H4 str. 11-4632 C2; identical to SEQ ID NO: 5727

SEQ ID NO: 18543 - protein, 209 aa, Escherichia coli O104:H4 str. 11-4632 C2; identical to SEQ ID NO: 18271

SEQ ID NO: 18544 - protein, 794 aa, Escherichia coli O104:H4 str. 11-4632 C2; identical to SEQ ID NO: 18204

SEQ ID NO: 18545 - protein, 102 aa, Escherichia coli O104:H4 str. 11-4632 C3; identical to SEQ ID NO: 6285

SEQ ID NO: 18546 - protein, 118 aa, Escherichia coli O104:H4 str. 11-4632 C3 [sequence omitted]

SEQ ID NO: 18547 - protein, 673 aa, Escherichia coli O104:H4 str. 11-4632 C3; identical to SEQ ID NO: 6298

SEQ ID NO: 18548 - protein, 162 aa, Escherichia coli O104:H4 str. 11-4632 C3; identical to SEQ ID NO: 5896

SEQ ID NO: 18549 - protein, 367 aa, Escherichia coli O104:H4 str. 11-4632 C3; identical to SEQ ID NO: 6310

SEQ ID NO: 18550 - protein, 200 aa, Escherichia coli O104:H4 str. 11-4632 C3; identical to SEQ ID NO: 6311

SEQ ID NO: 18551 - protein, 826 aa, Escherichia coli O104:H4 str. 11-4632 C3; identical to SEQ ID NO: 6301

SEQ ID NO: 18552 - protein, 224 aa, Escherichia coli O104:H4 str. 11-4632 C3; identical to SEQ ID NO: 6302

SEQ ID NO: 18553 - protein, 663 aa, Escherichia coli O104:H4 str. 11-4632 C3; identical to SEQ ID NO: 6307

SEQ ID NO: 18554 - protein, 274 aa, Escherichia coli O104:H4 str. 11-4632 C3; identical to SEQ ID NO: 6316

SEQ ID NO: 18555 - protein, 250 aa, Escherichia coli O104:H4 str. 11-4632 C3; identical to SEQ ID NO: 6317

SEQ ID NO: 18556 - protein, 880 aa, Escherichia coli O104:H4 str. 11-4632 C3; identical to SEQ ID NO: 18185

SEQ ID NO: 18557 - protein, 828 aa, Escherichia coli O104:H4 str. 11-4632 C3; identical to SEQ ID NO: 6308

SEQ ID NO: 18558 - protein, 518 aa, Escherichia coli O104:H4 str. 11-4632 C3; identical to SEQ ID NO: 6358

SEQ ID NO: 18559 - protein, 432 aa, Escherichia coli O104:H4 str. 11-4632 C3; identical to SEQ ID NO: 5727

SEQ ID NO: 18560 - protein, 359 aa, Escherichia coli O104:H4 str. 11-4632 C3; identical to SEQ ID NO: 6332

SEQ ID NO: 18561 - protein, 837 aa, Escherichia coli O104:H4 str. 11-4632 C3; identical to SEQ ID NO: 6340

SEQ ID NO: 18562 - protein, 249 aa, Escherichia coli O104:H4 str. 11-4632 C3; identical to SEQ ID NO: 6350

SEQ ID NO: 18563 - protein, 686 aa, Escherichia coli O104:H4 str. 11-4632 C3; identical to SEQ ID NO: 6339

SEQ ID NO: 18564 - protein, 231 aa, Escherichia coli O104:H4 str. 11-4632 C3; identical to SEQ ID NO: 6351

SEQ ID NO: 18565 - protein, 838 aa, Escherichia coli O104:H4 str. 11-4632 C3; identical to SEQ ID NO: 6352

SEQ ID NO: 18566 - protein, 678 aa, Escherichia coli O104:H4 str. 11-4632 C3; identical to SEQ ID NO: 6353

SEQ ID NO: 18567 - protein, 402 aa, Escherichia coli O104:H4 str. 11-4632 C3; identical to SEQ ID NO: 18029

SEQ ID NO: 18568 - protein, 843 aa, Escherichia coli O104:H4 str. 11-4632 C3; identical to SEQ ID NO: 6288

SEQ ID NO: 18569 - protein, 228 aa, Escherichia coli O104:H4 str. 11-4632 C3; identical to SEQ ID NO: 6185

SEQ ID NO: 18570 - protein, 243 aa, Escherichia coli O104:H4 str. 11-4632 C3; identical to SEQ ID NO: 6145

SEQ ID NO: 18571 - protein, 614 aa, Escherichia coli O104:H4 str. 11-4632 C3; identical to SEQ ID NO: 6303

SEQ ID NO: 18572 - protein, 208 aa, Escherichia coli O104:H4 str. 11-4632 C3; identical to SEQ ID NO: 5717

SEQ ID NO: 18573 - protein, 446 aa, Escherichia coli O104:H4 str. 11-4632 C3; identical to SEQ ID NO: 6312

SEQ ID NO: 18574 - protein, 237 aa, Escherichia coli O104:H4 str. 11-4632 C3; identical to SEQ ID NO: 6313

SEQ ID NO: 18575 - protein, 478 aa, Escherichia coli O104:H4 str. 11-4632 C3; identical to SEQ ID NO: 5711

SEQ ID NO: 18576 - protein, 732 aa, Escherichia coli O104:H4 str. 11-4632 C3; identical to SEQ ID NO: 18038

SEQ ID NO: 18577 - protein, 351 aa, Escherichia coli O104:H4 str. 11-4632 C3; identical to SEQ ID NO: 6282

SEQ ID NO: 18578 - protein, 774 aa, Escherichia coli O104:H4 str. 11-4632 C3; identical to SEQ ID NO: 18137

SEQ ID NO: 18579 - protein, 784 aa, Escherichia coli O104:H4 str. 11-4632 C3; identical to SEQ ID NO: 6283

SEQ ID NO: 18580 - protein, 866 aa, Escherichia coli O104:H4 str. 11-4632 C3; identical to SEQ ID NO: 17928

SEQ ID NO: 18581 - protein, 246 aa, Escherichia coli O104:H4 str. 11-4632 C3; identical to SEQ ID NO: 6342

SEQ ID NO: 18582 - protein, 747 aa, Escherichia coli O104:H4 str. 11-4632 C3; identical to SEQ ID NO: 6343

SEQ ID NO: 18583 - protein, 266 aa, Escherichia coli O104:H4 str. 11-4632 C3; identical to SEQ ID NO: 5772

SEQ ID NO: 18584 - protein, 161 aa, Escherichia coli O104:H4 str. 11-4632 C3; identical to SEQ ID NO: 5769

SEQ ID NO: 18585 - protein, 230 aa, Escherichia coli O104:H4 str. 11-4632 C3; identical to SEQ ID NO: 6294

SEQ ID NO: 18586 - protein, 869 aa, Escherichia coli O104:H4 str. 11-4632 C3; identical to SEQ ID NO: 17935

SEQ ID NO: 18587 - protein, 746 aa, Escherichia coli O104:H4 str. 11-4632 C3; identical to SEQ ID NO: 6296

SEQ ID NO: 18588 - protein, 193 aa, Escherichia coli O104:H4 str. 11-4632 C3; identical to SEQ ID NO: 6300

SEQ ID NO: 18589 - protein, 430 aa, Escherichia coli O104:H4 str. 11-4632 C3; identical to SEQ ID NO: 5758

SEQ ID NO: 18590 - protein, 331 aa, Escherichia coli O104:H4 str. 11-4632 C3; identical to SEQ ID NO: 6456

SEQ ID NO: 18591 - protein, 760 aa, Escherichia coli O104:H4 str. 11-4632 C3; identical to SEQ ID NO: 6322

SEQ ID NO: 18592 - protein, 203 aa, Escherichia coli O104:H4 str. 11-4632 C3; identical to SEQ ID NO: 6414

SEQ ID NO: 18593 - protein, 89 aa, Escherichia coli O104:H4 str. 11-4632 C3; identical to SEQ ID NO: 6233

SEQ ID NO: 18594 - protein, 360 aa, Escherichia coli O104:H4 str. 11-4632 C3; identical to SEQ ID NO: 6315

SEQ ID NO: 18595 - protein, 362 aa, Escherichia coli O104:H4 str. 11-4632 C3; identical to SEQ ID NO: 5809

SEQ ID NO: 18596 - protein, 233 aa, Escherichia coli O104:H4 str. 11-4632 C3; identical to SEQ ID NO: 6327

SEQ ID NO: 18597 - protein, 866 aa, Escherichia coli O104:H4 str. 11-4632 C3; identical to SEQ ID NO: 6328

SEQ ID NO: 18598 - protein, 229 aa, Escherichia coli O104:H4 str. 11-4632 C3; identical to SEQ ID NO: 9369

SEQ ID NO: 18599 - protein, 696 aa, Escherichia coli O104:H4 str. 11-4632 C3; identical to SEQ ID NO: 12728

SEQ ID NO: 18600 - protein, 191 aa, Escherichia coli O104:H4 str. 11-4632 C3; identical to SEQ ID NO: 5748

SEQ ID NO: 18601 - protein, 232 aa, Escherichia coli O104:H4 str. 11-4632 C3; identical to SEQ ID NO: 5747

SEQ ID NO: 18602 - protein, 729 aa, Escherichia coli O104:H4 str. 11-4632 C3; identical to SEQ ID NO: 6336

SEQ ID NO: 18603 - protein, 213 aa, Escherichia coli O104:H4 str. 11-4632 C3; identical to SEQ ID NO: 5744

SEQ ID NO: 18604 - protein, 203 aa, Escherichia coli O104:H4 str. 11-4632 C3; identical to SEQ ID NO: 6347

SEQ ID NO: 18605 - protein, 565 aa, Escherichia coli O104:H4 str. 11-4632 C3; identical to SEQ ID NO: 6395

SEQ ID NO: 18606 - protein, 207 aa, Escherichia coli O104:H4 str. 11-4632 C3; identical to SEQ ID NO: 5743

SEQ ID NO: 18607 - protein, 539 aa, Escherichia coli O104:H4 str. 11-4632 C3; identical to SEQ ID NO: 6525

SEQ ID NO: 18608 - protein, 700 aa, Escherichia coli O104:H4 str. 11-4632 C3; identical to SEQ ID NO: 6287

SEQ ID NO: 18609 - protein, 883 aa, Escherichia coli O104:H4 str. 11-4632 C3; identical to SEQ ID NO: 18005

SEQ ID NO: 18610 - protein, 236 aa, Escherichia coli O104:H4 str. 11-4632 C3; identical to SEQ ID NO: 6472

SEQ ID NO: 18611 - protein, 209 aa, Escherichia coli O104:H4 str. 11-4632 C3; identical to SEQ ID NO: 18271

SEQ ID NO: 18612 - protein, 794 aa, Escherichia coli O104:H4 str. 11-4632 C3; identical to SEQ ID NO: 18204

SEQ ID NO: 18613 - protein, 351 aa, Escherichia coli O104:H4 str. 11-4632 C4; identical to SEQ ID NO: 6282

SEQ ID NO: 18614 - protein, 230 aa, Escherichia coli O104:H4 str. 11-4632 C4; identical to SEQ ID NO: 6294

SEQ ID NO: 18615 - protein, 869 aa, Escherichia coli O104:H4 str. 11-4632 C4; identical to SEQ ID NO: 17935

SEQ ID NO: 18616 - protein, 746 aa, Escherichia coli O104:H4 str. 11-4632 C4; identical to SEQ ID NO: 6296

SEQ ID NO: 18617 - protein, 193 aa, Escherichia coli O104:H4 str. 11-4632 C4; identical to SEQ ID NO: 6300

SEQ ID NO: 18618 - protein, 430 aa, Escherichia coli O104:H4 str. 11-4632 C4; identical to SEQ ID NO: 5758

SEQ ID NO: 18619 - protein, 360 aa, Escherichia coli O104:H4 str. 11-4632 C4; identical to SEQ ID NO: 6315

SEQ ID NO: 18620 - protein, 331 aa, Escherichia coli O104:H4 str. 11-4632 C4; identical to SEQ ID NO: 6456

SEQ ID NO: 18621 - protein, 760 aa, Escherichia coli O104:H4 str. 11-4632 C4; identical to SEQ ID NO: 6322

SEQ ID NO: 18622 - protein, 203 aa, Escherichia coli O104:H4 str. 11-4632 C4; identical to SEQ ID NO: 6414

SEQ ID NO: 18623 - protein, 362 aa, Escherichia coli O104:H4 str. 11-4632 C4; identical to SEQ ID NO: 5809

SEQ ID NO: 18624 - protein, 233 aa, Escherichia coli O104:H4 str. 11-4632 C4; identical to SEQ ID NO: 6327

SEQ ID NO: 18625 - protein, 866 aa, Escherichia coli O104:H4 str. 11-4632 C4; identical to SEQ ID NO: 6328

SEQ ID NO: 18626 - protein, 229 aa, Escherichia coli O104:H4 str. 11-4632 C4; identical to SEQ ID NO: 9369

SEQ ID NO: 18627 - protein, 89 aa, Escherichia coli O104:H4 str. 11-4632 C4; identical to SEQ ID NO: 6233

SEQ ID NO: 18628 - protein, 696 aa, Escherichia coli O104:H4 str. 11-4632 C4; identical to SEQ ID NO: 12728

SEQ ID NO: 18629 - protein, 191 aa, Escherichia coli O104:H4 str. 11-4632 C4; identical to SEQ ID NO: 5748

SEQ ID NO: 18630 - protein, 232 aa, Escherichia coli O104:H4 str. 11-4632 C4; identical to SEQ ID NO: 5747

SEQ ID NO: 18631 - protein, 729 aa, Escherichia coli O104:H4 str. 11-4632 C4; identical to SEQ ID NO: 6336

SEQ ID NO: 18632 - protein, 213 aa, Escherichia coli O104:H4 str. 11-4632 C4; identical to SEQ ID NO: 5744

SEQ ID NO: 18633 - protein, 203 aa, Escherichia coli O104:H4 str. 11-4632 C4; identical to SEQ ID NO: 6347

SEQ ID NO: 18634 - protein, 565 aa, Escherichia coli O104:H4 str. 11-4632 C4; identical to SEQ ID NO: 6395

SEQ ID NO: 18635 - protein, 207 aa, Escherichia coli O104:H4 str. 11-4632 C4; identical to SEQ ID NO: 5743

SEQ ID NO: 18636 - protein, 539 aa, Escherichia coli O104:H4 str. 11-4632 C4; identical to SEQ ID NO: 6525

SEQ ID NO: 18637 - protein, 700 aa, Escherichia coli O104:H4 str. 11-4632 C4; identical to SEQ ID NO: 6287

SEQ ID NO: 18638 - protein, 883 aa, Escherichia coli O104:H4 str. 11-4632 C4; identical to SEQ ID NO: 18005

SEQ ID NO: 18639 - protein, 236 aa, Escherichia coli O104:H4 str. 11-4632 C4; identical to SEQ ID NO: 6472

SEQ ID NO: 18640 - protein, 102 aa, Escherichia coli O104:H4 str. 11-4632 C4; identical to SEQ ID NO: 6285

SEQ ID NO: 18641 - protein, 118 aa, Escherichia coli O104:H4 str. 11-4632 C4 [sequence omitted]

SEQ ID NO: 18642 - protein, 673 aa, Escherichia coli O104:H4 str. 11-4632 C4; identical to SEQ ID NO: 6298

SEQ ID NO: 18643 - protein, 826 aa, Escherichia coli O104:H4 str. 11-4632 C4; identical to SEQ ID NO: 6301

SEQ ID NO: 18644 - protein, 224 aa, Escherichia coli O104:H4 str. 11-4632 C4; identical to SEQ ID NO: 6302

SEQ ID NO: 18645 - protein, 663 aa, Escherichia coli O104:H4 str. 11-4632 C4; identical to SEQ ID NO: 6307

SEQ ID NO: 18646 - protein, 828 aa, Escherichia coli O104:H4 str. 11-4632 C4; identical to SEQ ID NO: 6308

SEQ ID NO: 18647 - protein, 162 aa, Escherichia coli O104:H4 str. 11-4632 C4; identical to SEQ ID NO: 5896

SEQ ID NO: 18648 - protein, 367 aa, Escherichia coli O104:H4 str. 11-4632 C4; identical to SEQ ID NO: 6310

SEQ ID NO: 18649 - protein, 200 aa, Escherichia coli O104:H4 str. 11-4632 C4; identical to SEQ ID NO: 6311

SEQ ID NO: 18650 - protein, 274 aa, Escherichia coli O104:H4 str. 11-4632 C4; identical to SEQ ID NO: 6316

SEQ ID NO: 18651 - protein, 250 aa, Escherichia coli O104:H4 str. 11-4632 C4; identical to SEQ ID NO: 6317

SEQ ID NO: 18652 - protein, 880 aa, Escherichia coli O104:H4 str. 11-4632 C4; identical to SEQ ID NO: 18185

SEQ ID NO: 18653 - protein, 518 aa, Escherichia coli O104:H4 str. 11-4632 C4; identical to SEQ ID NO: 6358

SEQ ID NO: 18654 - protein, 432 aa, Escherichia coli O104:H4 str. 11-4632 C4; identical to SEQ ID NO: 5727

SEQ ID NO: 18655 - protein, 359 aa, Escherichia coli O104:H4 str. 11-4632 C4; identical to SEQ ID NO: 6332

SEQ ID NO: 18656 - protein, 686 aa, Escherichia coli O104:H4 str. 11-4632 C4; identical to SEQ ID NO: 6339

SEQ ID NO: 18657 - protein, 837 aa, Escherichia coli O104:H4 str. 11-4632 C4; identical to SEQ ID NO: 6340

SEQ ID NO: 18658 - protein, 249 aa, Escherichia coli O104:H4 str. 11-4632 C4; identical to SEQ ID NO: 6350

SEQ ID NO: 18659 - protein, 231 aa, Escherichia coli O104:H4 str. 11-4632 C4; identical to SEQ ID NO: 6351

SEQ ID NO: 18660 - protein, 838 aa, Escherichia coli O104:H4 str. 11-4632 C4; identical to SEQ ID NO: 6352

SEQ ID NO: 18661 - protein, 678 aa, Escherichia coli O104:H4 str. 11-4632 C4; identical to SEQ ID NO: 6353

SEQ ID NO: 18662 - protein, 402 aa, Escherichia coli O104:H4 str. 11-4632 C4; identical to SEQ ID NO: 18029

SEQ ID NO: 18663 - protein, 843 aa, Escherichia coli O104:H4 str. 11-4632 C4; identical to SEQ ID NO: 6288

SEQ ID NO: 18664 - protein, 228 aa, Escherichia coli O104:H4 str. 11-4632 C4; identical to SEQ ID NO: 6185

SEQ ID NO: 18665 - protein, 243 aa, Escherichia coli O104:H4 str. 11-4632 C4; identical to SEQ ID NO: 6145

SEQ ID NO: 18666 - protein, 208 aa, Escherichia coli O104:H4 str. 11-4632 C4; identical to SEQ ID NO: 5717

SEQ ID NO: 18667 - protein, 614 aa, Escherichia coli O104:H4 str. 11-4632 C4; identical to SEQ ID NO: 6303

SEQ ID NO: 18668 - protein, 446 aa, Escherichia coli O104:H4 str. 11-4632 C4; identical to SEQ ID NO: 6312

SEQ ID NO: 18669 - protein, 237 aa, Escherichia coli O104:H4 str. 11-4632 C4; identical to SEQ ID NO: 6313

SEQ ID NO: 18670 - protein, 478 aa, Escherichia coli O104:H4 str. 11-4632 C4; identical to SEQ ID NO: 5711

SEQ ID NO: 18671 - protein, 731 aa, Escherichia coli O104:H4 str. 11-4632 C4; identical to SEQ ID NO: 17986

SEQ ID NO: 18672 - protein, 774 aa, Escherichia coli O104:H4 str. 11-4632 C4; identical to SEQ ID NO: 18137

SEQ ID NO: 18673 - protein, 784 aa, Escherichia coli O104:H4 str. 11-4632 C4; identical to SEQ ID NO: 6283

SEQ ID NO: 18674 - protein, 866 aa, Escherichia coli O104:H4 str. 11-4632 C4; identical to SEQ ID NO: 17928

SEQ ID NO: 18675 - protein, 246 aa, Escherichia coli O104:H4 str. 11-4632 C4; identical to SEQ ID NO: 6342

SEQ ID NO: 18676 - protein, 747 aa, Escherichia coli O104:H4 str. 11-4632 C4; identical to SEQ ID NO: 6343

SEQ ID NO: 18677 - protein, 266 aa, Escherichia coli O104:H4 str. 11-4632 C4; identical to SEQ ID NO: 5772

SEQ ID NO: 18678 - protein, 161 aa, Escherichia coli O104:H4 str. 11-4632 C4; identical to SEQ ID NO: 5769

SEQ ID NO: 18679 - protein, 209 aa, Escherichia coli O104:H4 str. 11-4632 C4; identical to SEQ ID NO: 18271

SEQ ID NO: 18680 - protein, 794 aa, Escherichia coli O104:H4 str. 11-4632 C4; identical to SEQ ID NO: 18204

SEQ ID NO: 18681 - protein, 686 aa, Escherichia coli O104:H4 str. 11-4632 C5; identical to SEQ ID NO: 6339

SEQ ID NO: 18682 - protein, 837 aa, Escherichia coli O104:H4 str. 11-4632 C5; identical to SEQ ID NO: 6340

SEQ ID NO: 18683 - protein, 249 aa, Escherichia coli O104:H4 str. 11-4632 C5; identical to SEQ ID NO: 6350

SEQ ID NO: 18684 - protein, 231 aa, Escherichia coli O104:H4 str. 11-4632 C5; identical to SEQ ID NO: 6351

SEQ ID NO: 18685 - protein, 838 aa, Escherichia coli O104:H4 str. 11-4632 C5; identical to SEQ ID NO: 6352

SEQ ID NO: 18686 - protein, 678 aa, Escherichia coli O104:H4 str. 11-4632 C5; identical to SEQ ID NO: 6353

SEQ ID NO: 18687 - protein, 402 aa, Escherichia coli O104:H4 str. 11-4632 C5; identical to SEQ ID NO: 18029

SEQ ID NO: 18688 - protein, 843 aa, Escherichia coli O104:H4 str. 11-4632 C5; identical to SEQ ID NO: 6288

SEQ ID NO: 18689 - protein, 228 aa, Escherichia coli O104:H4 str. 11-4632 C5; identical to SEQ ID NO: 6185

SEQ ID NO: 18690 - protein, 243 aa, Escherichia coli O104:H4 str. 11-4632 C5; identical to SEQ ID NO: 6145

SEQ ID NO: 18691 - protein, 208 aa, Escherichia coli O104:H4 str. 11-4632 C5; identical to SEQ ID NO: 5717

SEQ ID NO: 18692 - protein, 614 aa, Escherichia coli O104:H4 str. 11-4632 C5; identical to SEQ ID NO: 6303

SEQ ID NO: 18693 - protein, 446 aa, Escherichia coli O104:H4 str. 11-4632 C5; identical to SEQ ID NO: 6312

SEQ ID NO: 18694 - protein, 237 aa, Escherichia coli O104:H4 str. 11-4632 C5; identical to SEQ ID NO: 6313

SEQ ID NO: 18695 - protein, 478 aa, Escherichia coli O104:H4 str. 11-4632 C5; identical to SEQ ID NO: 5711

SEQ ID NO: 18696 - protein, 732 aa, Escherichia coli O104:H4 str. 11-4632 C5; identical to SEQ ID NO: 18038

SEQ ID NO: 18697 - protein, 774 aa, Escherichia coli O104:H4 str. 11-4632 C5; identical to SEQ ID NO: 18137

SEQ ID NO: 18698 - protein, 784 aa, Escherichia coli O104:H4 str. 11-4632 C5; identical to SEQ ID NO: 6283

SEQ ID NO: 18699 - protein, 866 aa, Escherichia coli O104:H4 str. 11-4632 C5; identical to SEQ ID NO: 17928

SEQ ID NO: 18700 - protein, 246 aa, Escherichia coli O104:H4 str. 11-4632 C5; identical to SEQ ID NO: 6342

SEQ ID NO: 18701 - protein, 747 aa, Escherichia coli O104:H4 str. 11-4632 C5; identical to SEQ ID NO: 6343

SEQ ID NO: 18702 - protein, 266 aa, Escherichia coli O104:H4 str. 11-4632 C5; identical to SEQ ID NO: 5772

SEQ ID NO: 18703 - protein, 161 aa, Escherichia coli O104:H4 str. 11-4632 C5; identical to SEQ ID NO: 5769

SEQ ID NO: 18704 - protein, 351 aa, Escherichia coli O104:H4 str. 11-4632 C5; identical to SEQ ID NO: 6282

SEQ ID NO: 18705 - protein, 230 aa, Escherichia coli O104:H4 str. 11-4632 C5; identical to SEQ ID NO: 6294

SEQ ID NO: 18706 - protein, 869 aa, Escherichia coli O104:H4 str. 11-4632 C5; identical to SEQ ID NO: 17935

SEQ ID NO: 18707 - protein, 746 aa, Escherichia coli O104:H4 str. 11-4632 C5; identical to SEQ ID NO: 6296

SEQ ID NO: 18708 - protein, 193 aa, Escherichia coli O104:H4 str. 11-4632 C5; identical to SEQ ID NO: 6300

SEQ ID NO: 18709 - protein, 430 aa, Escherichia coli O104:H4 str. 11-4632 C5; identical to SEQ ID NO: 5758

SEQ ID NO: 18710 - protein, 360 aa, Escherichia coli O104:H4 str. 11-4632 C5; identical to SEQ ID NO: 6315

SEQ ID NO: 18711 - protein, 331 aa, Escherichia coli O104:H4 str. 11-4632 C5; identical to SEQ ID NO: 6456

SEQ ID NO: 18712 - protein, 760 aa, Escherichia coli O104:H4 str. 11-4632 C5; identical to SEQ ID NO: 6322

SEQ ID NO: 18713 - protein, 203 aa, Escherichia coli O104:H4 str. 11-4632 C5; identical to SEQ ID NO: 6414

SEQ ID NO: 18714 - protein, 362 aa, Escherichia coli O104:H4 str. 11-4632 C5; identical to SEQ ID NO: 5809

SEQ ID NO: 18715 - protein, 233 aa, Escherichia coli O104:H4 str. 11-4632 C5; identical to SEQ ID NO: 6327

SEQ ID NO: 18716 - protein, 866 aa, Escherichia coli O104:H4 str. 11-4632 C5; identical to SEQ ID NO: 6328

SEQ ID NO: 18717 - protein, 229 aa, Escherichia coli O104:H4 str. 11-4632 C5; identical to SEQ ID NO: 9369

SEQ ID NO: 18718 - protein, 89 aa, Escherichia coli O104:H4 str. 11-4632 C5; identical to SEQ ID NO: 6233

SEQ ID NO: 18719 - protein, 696 aa, Escherichia coli O104:H4 str. 11-4632 C5; identical to SEQ ID NO: 12728

SEQ ID NO: 18720 - protein, 191 aa, Escherichia coli O104:H4 str. 11-4632 C5; identical to SEQ ID NO: 5748

SEQ ID NO: 18721 - protein, 232 aa, Escherichia coli O104:H4 str. 11-4632 C5; identical to SEQ ID NO: 5747

SEQ ID NO: 18722 - protein, 729 aa, Escherichia coli O104:H4 str. 11-4632 C5; identical to SEQ ID NO: 6336

SEQ ID NO: 18723 - protein, 213 aa, Escherichia coli O104:H4 str. 11-4632 C5; identical to SEQ ID NO: 5744

SEQ ID NO: 18724 - protein, 203 aa, Escherichia coli O104:H4 str. 11-4632 C5; identical to SEQ ID NO: 6347

SEQ ID NO: 18725 - protein, 565 aa, Escherichia coli O104:H4 str. 11-4632 C5; identical to SEQ ID NO: 6395

SEQ ID NO: 18726 - protein, 207 aa, Escherichia coli O104:H4 str. 11-4632 C5; identical to SEQ ID NO: 5743

SEQ ID NO: 18727 - protein, 539 aa, Escherichia coli O104:H4 str. 11-4632 C5; identical to SEQ ID NO: 6525

SEQ ID NO: 18728 - protein, 700 aa, Escherichia coli O104:H4 str. 11-4632 C5; identical to SEQ ID NO: 6287

SEQ ID NO: 18729 - protein, 883 aa, Escherichia coli O104:H4 str. 11-4632 C5; identical to SEQ ID NO: 18005

SEQ ID NO: 18730 - protein, 236 aa, Escherichia coli O104:H4 str. 11-4632 C5; identical to SEQ ID NO: 6472

SEQ ID NO: 18731 - protein, 102 aa, Escherichia coli O104:H4 str. 11-4632 C5; identical to SEQ ID NO: 6285

SEQ ID NO: 18732 - protein, 118 aa, Escherichia coli O104:H4 str. 11-4632 C5 [sequence omitted]

SEQ ID NO: 18733 - protein, 673 aa, Escherichia coli O104:H4 str. 11-4632 C5; identical to SEQ ID NO: 6298

SEQ ID NO: 18734 - protein, 826 aa, Escherichia coli O104:H4 str. 11-4632 C5; identical to SEQ ID NO: 6301

SEQ ID NO: 18735 - protein, 224 aa, Escherichia coli O104:H4 str. 11-4632 C5; identical to SEQ ID NO: 6302

SEQ ID NO: 18736 - protein, 663 aa, Escherichia coli O104:H4 str. 11-4632 C5; identical to SEQ ID NO: 6307

SEQ ID NO: 18737 - protein, 828 aa, Escherichia coli O104:H4 str. 11-4632 C5; identical to SEQ ID NO: 6308

SEQ ID NO: 18738 - protein, 162 aa, Escherichia coli O104:H4 str. 11-4632 C5; identical to SEQ ID NO: 5896

SEQ ID NO: 18739 - protein, 367 aa, Escherichia coli O104:H4 str. 11-4632 C5; identical to SEQ ID NO: 6310

SEQ ID NO: 18740 - protein, 200 aa, Escherichia coli O104:H4 str. 11-4632 C5; identical to SEQ ID NO: 6311

SEQ ID NO: 18741 - protein, 274 aa, Escherichia coli O104:H4 str. 11-4632 C5; identical to SEQ ID NO: 6316

SEQ ID NO: 18742 - protein, 250 aa, Escherichia coli O104:H4 str. 11-4632 C5; identical to SEQ ID NO: 6317

SEQ ID NO: 18743 - protein, 880 aa, Escherichia coli O104:H4 str. 11-4632 C5; identical to SEQ ID NO: 18185

SEQ ID NO: 18744 - protein, 518 aa, Escherichia coli O104:H4 str. 11-4632 C5; identical to SEQ ID NO: 6358

SEQ ID NO: 18745 - protein, 359 aa, Escherichia coli O104:H4 str. 11-4632 C5; identical to SEQ ID NO: 6332

SEQ ID NO: 18746 - protein, 432 aa, Escherichia coli O104:H4 str. 11-4632 C5; identical to SEQ ID NO: 5727

SEQ ID NO: 18747 - protein, 209 aa, Escherichia coli O104:H4 str. 11-4632 C5; identical to SEQ ID NO: 18271

SEQ ID NO: 18748 - protein, 794 aa, Escherichia coli O104:H4 str. 11-4632 C5; identical to SEQ ID NO: 18204

SEQ ID NO: 18749 - protein, 518 aa, Escherichia coli O104:H4 str. C227-11; identical to SEQ ID NO: 6358

SEQ ID NO: 18750 - protein, 880 aa, Escherichia coli O104:H4 str. C227-11; identical to SEQ ID NO: 18185

SEQ ID NO: 18751 - protein, 250 aa, Escherichia coli O104:H4 str. C227-11; identical to SEQ ID NO: 6317

SEQ ID NO: 18752 - protein, 274 aa, Escherichia coli O104:H4 str. C227-11; identical to SEQ ID NO: 6316

SEQ ID NO: 18753 - protein, 200 aa, Escherichia coli O104:H4 str. C227-11; identical to SEQ ID NO: 6311

SEQ ID NO: 18754 - protein, 367 aa, Escherichia coli O104:H4 str. C227-11; identical to SEQ ID NO: 6310

SEQ ID NO: 18755 - protein, 162 aa, Escherichia coli O104:H4 str. C227-11; identical to SEQ ID NO: 5896

SEQ ID NO: 18756 - protein, 828 aa, Escherichia coli O104:H4 str. C227-11; identical to SEQ ID NO: 6308

SEQ ID NO: 18757 - protein, 663 aa, Escherichia coli O104:H4 str. C227-11; identical to SEQ ID NO: 6307

SEQ ID NO: 18758 - protein, 224 aa, Escherichia coli O104:H4 str. C227-11; identical to SEQ ID NO: 6302

SEQ ID NO: 18759 - protein, 669 aa, Escherichia coli O104:H4 str. C227-11
MTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGALIWRTVFPKRLL

SEQ ID NO: 18760 - protein, 431 aa, Escherichia coli O104:H4 str. C227-11; identical to SEQ ID NO: 6791

SEQ ID NO: 18761 - protein, 230 aa, Escherichia coli O104:H4 str. C227-11; identical to SEQ ID NO: 6294

SEQ ID NO: 18762 - protein, 869 aa, Escherichia coli O104:H4 str. C227-11; identical to SEQ ID NO: 17935

SEQ ID NO: 18763 - protein, 746 aa, Escherichia coli O104:H4 str. C227-11; identical to SEQ ID NO: 6296

SEQ ID NO: 18764 - protein, 193 aa, Escherichia coli O104:H4 str. C227-11; identical to SEQ ID NO: 6300

SEQ ID NO: 18765 - protein, 360 aa, Escherichia coli O104:H4 str. C227-11; identical to SEQ ID NO: 6315

SEQ ID NO: 18766 - protein, 332 aa, Escherichia coli O104:H4 str. C227-11; identical to SEQ ID NO: 6321

SEQ ID NO: 18767 - protein, 760 aa, Escherichia coli O104:H4 str. C227-11; identical to SEQ ID NO: 6322

SEQ ID NO: 18768 - protein, 204 aa, Escherichia coli O104:H4 str. C227-11; identical to SEQ ID NO: 5755

SEQ ID NO: 18769 - protein, 362 aa, Escherichia coli O104:H4 str. C227-11; identical to SEQ ID NO: 5809

SEQ ID NO: 18770 - protein, 224 aa, Escherichia coli O104:H4 str. C227-11; identical to SEQ ID NO: 7869

SEQ ID NO: 18771 - protein, 691 aa, Escherichia coli O104:H4 str. C227-11
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGKLTC

SEQ ID NO: 18772 - protein, 236 aa, Escherichia coli O104:H4 str. C227-11; identical to SEQ ID NO: 6329

SEQ ID NO: 18773 - protein, 161 aa, Escherichia coli O104:H4 str. C227-11; identical to SEQ ID NO: 5769

SEQ ID NO: 18774 - protein, 266 aa, Escherichia coli O104:H4 str. C227-11; identical to SEQ ID NO: 5772

SEQ ID NO: 18775 - protein, 747 aa, Escherichia coli O104:H4 str. C227-11; identical to SEQ ID NO: 6343

SEQ ID NO: 18776 - protein, 246 aa, Escherichia coli O104:H4 str. C227-11; identical to SEQ ID NO: 6342

SEQ ID NO: 18777 - protein, 866 aa, Escherichia coli O104:H4 str. C227-11; identical to SEQ ID NO: 17928

SEQ ID NO: 18778 - protein, 784 aa, Escherichia coli O104:H4 str. C227-11; identical to SEQ ID NO: 6283

SEQ ID NO: 18779 - protein, 774 aa, Escherichia coli O104:H4 str. C227-11; identical to SEQ ID NO: 18137

SEQ ID NO: 18780 - protein, 207 aa, Escherichia coli O104:H4 str. C227-11; identical to SEQ ID NO: 5743

SEQ ID NO: 18781 - protein, 203 aa, Escherichia coli O104:H4 str. C227-11; identical to SEQ ID NO: 6347

SEQ ID NO: 18782 - protein, 213 aa, Escherichia coli O104:H4 str. C227-11; identical to SEQ ID NO: 5744

SEQ ID NO: 18783 - protein, 729 aa, Escherichia coli O104:H4 str. C227-11; identical to SEQ ID NO: 6336

SEQ ID NO: 18784 - protein, 232 aa, Escherichia coli O104:H4 str. C227-11; identical to SEQ ID NO: 5747

SEQ ID NO: 18785 - protein, 191 aa, Escherichia coli O104:H4 str. C227-11; identical to SEQ ID NO: 5748

SEQ ID NO: 18786 - protein, 511 aa, Escherichia coli O104:H4 str. C227-11; identical to SEQ ID NO: 5749

SEQ ID NO: 18787 - protein, 89 aa, Escherichia coli O104:H4 str. C227-11; identical to SEQ ID NO: 6233

SEQ ID NO: 18788 - protein, 111 aa, Escherichia coli O104:H4 str. C227-11; identical to SEQ ID NO: 7885

SEQ ID NO: 18789 - protein, 130 aa, Escherichia coli O104:H4 str. C227-11
MLSPESLCYGEKHEKKRAFLGLLLVSACASVFAANNETSKSVTFPKCEGLDAAGIAASVKRDYQQNRVARWADDQKIVGQADPVAWVSLQDIQGKDDKWSVPLTVRGKSADIHYQVSVDCKAGMAEYQRR

SEQ ID NO: 18790 - protein, 732 aa, Escherichia coli O104:H4 str. C227-11; identical to SEQ ID NO: 18038

SEQ ID NO: 18791 - protein, 686 aa, Escherichia coli O104:H4 str. C227-11; identical to SEQ ID NO: 6339

SEQ ID NO: 18792 - protein, 834 aa, Escherichia coli O104:H4 str. C227-11; identical to SEQ ID NO: 17975

SEQ ID NO: 18793 - protein, 249 aa, Escherichia coli O104:H4 str. C227-11; identical to SEQ ID NO: 6350

SEQ ID NO: 18794 - protein, 231 aa, Escherichia coli O104:H4 str. C227-11; identical to SEQ ID NO: 6351

SEQ ID NO: 18795 - protein, 838 aa, Escherichia coli O104:H4 str. C227-11; identical to SEQ ID NO: 6352

SEQ ID NO: 18796 - protein, 678 aa, Escherichia coli O104:H4 str. C227-11; identical to SEQ ID NO: 6353

SEQ ID NO: 18797 - protein, 843 aa, Escherichia coli O104:H4 str. C227-11; identical to SEQ ID NO: 6288

SEQ ID NO: 18798 - protein, 228 aa, Escherichia coli O104:H4 str. C227-11; identical to SEQ ID NO: 6185

SEQ ID NO: 18799 - protein, 243 aa, Escherichia coli O104:H4 str. C227-11; identical to SEQ ID NO: 6145

SEQ ID NO: 18800 - protein, 412 aa, Escherichia coli O104:H4 str. C227-11; identical to SEQ ID NO: 6284

SEQ ID NO: 18801 - protein, 432 aa, Escherichia coli O104:H4 str. C227-11; identical to SEQ ID NO: 5727

SEQ ID NO: 18802 - protein, 659 aa, Escherichia coli O104:H4 str. C227-11
MLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSSDSYRSKFNLSGPIEDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 18803 - protein, 539 aa, Escherichia coli O104:H4 str. C227-11; identical to SEQ ID NO: 6525

SEQ ID NO: 18804 - protein, 700 aa, Escherichia coli O104:H4 str. C227-11; identical to SEQ ID NO: 6287

SEQ ID NO: 18805 - protein, 302 aa, Escherichia coli O104:H4 str. C227-11
MPEYRSSCQSWYKKSELLDNKEHSAEKHVPDNSACTPLQDRLADASTEFDVGQQHLSLSVPQIYVGRMARGYVSPELWEEGINAGLLNYSFNGNSINNRSNHNAGKSNYAYLNLQSGINIGSWRLRDNSTWSYNSGSSNSSNSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPSSYKVA

SEQ ID NO: 18806 - protein, 239 aa, Escherichia coli O104:H4 str. C227-11; identical to SEQ ID NO: 6291

SEQ ID NO: 18807 - protein, 359 aa, Escherichia coli O104:H4 str. C227-11; identical to SEQ ID NO: 6332

SEQ ID NO: 18808 - protein, 478 aa, Escherichia coli O104:H4 str. C227-11; identical to SEQ ID NO: 5711

SEQ ID NO: 18809 - protein, 237 aa, Escherichia coli O104:H4 str. C227-11; identical to SEQ ID NO: 6313

SEQ ID NO: 18810 - protein, 446 aa, Escherichia coli O104:H4 str. C227-11; identical to SEQ ID NO: 6312

SEQ ID NO: 18811 - protein, 208 aa, Escherichia coli O104:H4 str. C227-11; identical to SEQ ID NO: 5717

SEQ ID NO: 18812 - protein, 426 aa, Escherichia coli O104:H4 str. C227-11
MGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 18813 - protein, 351 aa, Escherichia coli O104:H4 str. C227-11; identical to SEQ ID NO: 6282

SEQ ID NO: 18814 - protein, 236 aa, Escherichia coli O104:H4 str. C227-11
MKIRRIVSTIAIALSVFTFAHAQSFENVENNAKVFSLHLGATRMLYKPNSSGETLAVINEHNYPILVQANVLSEDQKNIAPFIITPPLFRLDALQSSRLRIVKTEGAFPIDRESLQWICVKAIPPKYEDKWAKEEVSGKKSDEATMNIQVSVSSCIKLFVRPADVKGQPDDVAGKIKWQKVGNKLKGVNPTPFYMDIAELRVGEKEITETHYIAPFSSYEYPMPVNGGGRPMESGD

SEQ ID NO: 18815 - protein, 317 aa, Escherichia coli O104:H4 str. C227-11
MLGSDENMVPYNQREFAPVVRGIARTQARIEVRQNGYLIQSRIVSPGAFALTDLPVTGNGGDLQVWVLESDGTIQTFNVPFTTPAIALREGYLKYNVTVGEYRPSDDSIEGAYLGQLTAMYGLPWSLTAFGGIQVSEHYQGNALGLGLSLGGFGSISLDTIYSRGQQKGYSNEIGKTWRVRYDKSFELTGTSFAAGYQDSSAGYHSLADVLDTYRNGTAYRSYDNRIRRTTINISQALGEWGSVALNGGRDEYRDKVKQDYIGASYSNSWKGITFAVNWSRNNNIGDYYSNSLRTENNLNLWMSIPMKRWLGGMIKG

SEQ ID NO: 18816 - protein, 883 aa, Escherichia coli O104:H4 str. C227-11; identical to SEQ ID NO: 18005

SEQ ID NO: 18817 - protein, 236 aa, Escherichia coli O104:H4 str. C227-11; identical to SEQ ID NO: 6472

SEQ ID NO: 18818 - protein, 102 aa, Escherichia coli O104:H4 str. C227-11; identical to SEQ ID NO: 6285

SEQ ID NO: 18819 - protein, 118 aa, Escherichia coli O104:H4 str. C227-11 [sequence omitted]

SEQ ID NO: 18820 - protein, 826 aa, Escherichia coli O104:H4 str. C227-11; identical to SEQ ID NO: 6301

SEQ ID NO: 18821 - protein, 673 aa, Escherichia coli O104:H4 str. C227-11; identical to SEQ ID NO: 6298

SEQ ID NO: 18822 - protein, 837 aa, Escherichia coli O104:H4 str. C227-11; identical to SEQ ID NO: 6340

SEQ ID NO: 18823 - protein, 402 aa, Escherichia coli O104:H4 str. C227-11; identical to SEQ ID NO: 18029

SEQ ID NO: 18824 - protein, 614 aa, Escherichia coli O104:H4 str. C227-11; identical to SEQ ID NO: 6303

SEQ ID NO: 18825 - protein, 731 aa, Escherichia coli O104:H4 str. C227-11; identical to SEQ ID NO: 17986

SEQ ID NO: 18826 - protein, 233 aa, Escherichia coli O104:H4 str. C227-11; identical to SEQ ID NO: 6327

SEQ ID NO: 18827 - protein, 866 aa, Escherichia coli O104:H4 str. C227-11; identical to SEQ ID NO: 6328

SEQ ID NO: 18828 - protein, 229 aa, Escherichia coli O104:H4 str. C227-11; identical to SEQ ID NO: 9369

SEQ ID NO: 18829 - protein, 430 aa, Escherichia coli O104:H4 str. C227-11; identical to SEQ ID NO: 5758

SEQ ID NO: 18830 - protein, 331 aa, Escherichia coli O104:H4 str. C227-11; identical to SEQ ID NO: 6456

SEQ ID NO: 18831 - protein, 203 aa, Escherichia coli O104:H4 str. C227-11; identical to SEQ ID NO: 6414

SEQ ID NO: 18832 - protein, 565 aa, Escherichia coli O104:H4 str. C227-11; identical to SEQ ID NO: 6395

SEQ ID NO: 18833 - protein, 696 aa, Escherichia coli O104:H4 str. C227-11; identical to SEQ ID NO: 12728

SEQ ID NO: 18834 - protein, 209 aa, Escherichia coli O104:H4 str. C227-11; identical to SEQ ID NO: 18271

SEQ ID NO: 18835 - protein, 794 aa, Escherichia coli O104:H4 str. C227-11; identical to SEQ ID NO: 18204

SEQ ID NO: 18836 - protein, 731 aa, Escherichia coli O104:H4 str. C236-11; identical to SEQ ID NO: 17986

SEQ ID NO: 18837 - protein, 784 aa, Escherichia coli O104:H4 str. C236-11; identical to SEQ ID NO: 6283

SEQ ID NO: 18838 - protein, 866 aa, Escherichia coli O104:H4 str. C236-11; identical to SEQ ID NO: 17928

SEQ ID NO: 18839 - protein, 246 aa, Escherichia coli O104:H4 str. C236-11; identical to SEQ ID NO: 6342

SEQ ID NO: 18840 - protein, 747 aa, Escherichia coli O104:H4 str. C236-11; identical to SEQ ID NO: 6343

SEQ ID NO: 18841 - protein, 266 aa, Escherichia coli O104:H4 str. C236-11; identical to SEQ ID NO: 5772

SEQ ID NO: 18842 - protein, 161 aa, Escherichia coli O104:H4 str. C236-11; identical to SEQ ID NO: 5769

SEQ ID NO: 18843 - protein, 230 aa, Escherichia coli O104:H4 str. C236-11; identical to SEQ ID NO: 6294

SEQ ID NO: 18844 - protein, 869 aa, Escherichia coli O104:H4 str. C236-11; identical to SEQ ID NO: 17935

SEQ ID NO: 18845 - protein, 774 aa, Escherichia coli O104:H4 str. C236-11; identical to SEQ ID NO: 18137

SEQ ID NO: 18846 - protein, 351 aa, Escherichia coli O104:H4 str. C236-11; identical to SEQ ID NO: 6282

SEQ ID NO: 18847 - protein, 760 aa, Escherichia coli O104:H4 str. C236-11; identical to SEQ ID NO: 6322

SEQ ID NO: 18848 - protein, 729 aa, Escherichia coli O104:H4 str. C236-11; identical to SEQ ID NO: 6336

SEQ ID NO: 18849 - protein, 213 aa, Escherichia coli O104:H4 str. C236-11; identical to SEQ ID NO: 5744

SEQ ID NO: 18850 - protein, 203 aa, Escherichia coli O104:H4 str. C236-11; identical to SEQ ID NO: 6414

SEQ ID NO: 18851 - protein, 203 aa, Escherichia coli O104:H4 str. C236-11; identical to SEQ ID NO: 6347

SEQ ID NO: 18852 - protein, 565 aa, Escherichia coli O104:H4 str. C236-11; identical to SEQ ID NO: 6395

SEQ ID NO: 18853 - protein, 207 aa, Escherichia coli O104:H4 str. C236-11; identical to SEQ ID NO: 5743

SEQ ID NO: 18854 - protein, 102 aa, Escherichia coli O104:H4 str. C236-11; identical to SEQ ID NO: 6285

SEQ ID NO: 18855 - protein, 746 aa, Escherichia coli O104:H4 str. C236-11; identical to SEQ ID NO: 6296

SEQ ID NO: 18856 - protein, 362 aa, Escherichia coli O104:H4 str. C236-11; identical to SEQ ID NO: 5809

SEQ ID NO: 18857 - protein, 233 aa, Escherichia coli O104:H4 str. C236-11; identical to SEQ ID NO: 6327

SEQ ID NO: 18858 - protein, 866 aa, Escherichia coli O104:H4 str. C236-11; identical to SEQ ID NO: 6328

SEQ ID NO: 18859 - protein, 229 aa, Escherichia coli O104:H4 str. C236-11; identical to SEQ ID NO: 9369

SEQ ID NO: 18860 - protein, 193 aa, Escherichia coli O104:H4 str. C236-11; identical to SEQ ID NO: 6300

SEQ ID NO: 18861 - protein, 89 aa, Escherichia coli O104:H4 str. C236-11; identical to SEQ ID NO: 6233

SEQ ID NO: 18862 - protein, 430 aa, Escherichia coli O104:H4 str. C236-11; identical to SEQ ID NO: 5758

SEQ ID NO: 18863 - protein, 360 aa, Escherichia coli O104:H4 str. C236-11; identical to SEQ ID NO: 6315

SEQ ID NO: 18864 - protein, 696 aa, Escherichia coli O104:H4 str. C236-11; identical to SEQ ID NO: 12728

SEQ ID NO: 18865 - protein, 539 aa, Escherichia coli O104:H4 str. C236-11; identical to SEQ ID NO: 6525

SEQ ID NO: 18866 - protein, 700 aa, Escherichia coli O104:H4 str. C236-11; identical to SEQ ID NO: 6287

SEQ ID NO: 18867 - protein, 331 aa, Escherichia coli O104:H4 str. C236-11; identical to SEQ ID NO: 6456

SEQ ID NO: 18868 - protein, 883 aa, Escherichia coli O104:H4 str. C236-11; identical to SEQ ID NO: 18005

SEQ ID NO: 18869 - protein, 236 aa, Escherichia coli O104:H4 str. C236-11; identical to SEQ ID NO: 6472

SEQ ID NO: 18870 - protein, 191 aa, Escherichia coli O104:H4 str. C236-11; identical to SEQ ID NO: 5748

SEQ ID NO: 18871 - protein, 232 aa, Escherichia coli O104:H4 str. C236-11; identical to SEQ ID NO: 5747

SEQ ID NO: 18872 - protein, 118 aa, Escherichia coli O104:H4 str. C236-11 [sequence omitted]

SEQ ID NO: 18873 - protein, 274 aa, Escherichia coli O104:H4 str. C236-11; identical to SEQ ID NO: 6316

SEQ ID NO: 18874 - protein, 250 aa, Escherichia coli O104:H4 str. C236-11; identical to SEQ ID NO: 6317

SEQ ID NO: 18875 - protein, 880 aa, Escherichia coli O104:H4 str. C236-11; identical to SEQ ID NO: 18185

SEQ ID NO: 18876 - protein, 826 aa, Escherichia coli O104:H4 str. C236-11; identical to SEQ ID NO: 6301

SEQ ID NO: 18877 - protein, 224 aa, Escherichia coli O104:H4 str. C236-11; identical to SEQ ID NO: 6302

SEQ ID NO: 18878 - protein, 673 aa, Escherichia coli O104:H4 str. C236-11; identical to SEQ ID NO: 6298

SEQ ID NO: 18879 - protein, 663 aa, Escherichia coli O104:H4 str. C236-11; identical to SEQ ID NO: 6307

SEQ ID NO: 18880 - protein, 432 aa, Escherichia coli O104:H4 str. C236-11; identical to SEQ ID NO: 5727

SEQ ID NO: 18881 - protein, 828 aa, Escherichia coli O104:H4 str. C236-11; identical to SEQ ID NO: 6308

SEQ ID NO: 18882 - protein, 162 aa, Escherichia coli O104:H4 str. C236-11; identical to SEQ ID NO: 5896

SEQ ID NO: 18883 - protein, 367 aa, Escherichia coli O104:H4 str. C236-11; identical to SEQ ID NO: 6310

SEQ ID NO: 18884 - protein, 200 aa, Escherichia coli O104:H4 str. C236-11; identical to SEQ ID NO: 6311

SEQ ID NO: 18885 - protein, 518 aa, Escherichia coli O104:H4 str. C236-11; identical to SEQ ID NO: 6358

SEQ ID NO: 18886 - protein, 359 aa, Escherichia coli O104:H4 str. C236-11; identical to SEQ ID NO: 6332

SEQ ID NO: 18887 - protein, 231 aa, Escherichia coli O104:H4 str. C236-11; identical to SEQ ID NO: 6351

SEQ ID NO: 18888 - protein, 838 aa, Escherichia coli O104:H4 str. C236-11; identical to SEQ ID NO: 6352

SEQ ID NO: 18889 - protein, 678 aa, Escherichia coli O104:H4 str. C236-11; identical to SEQ ID NO: 6353

SEQ ID NO: 18890 - protein, 686 aa, Escherichia coli O104:H4 str. C236-11; identical to SEQ ID NO: 6339

SEQ ID NO: 18891 - protein, 837 aa, Escherichia coli O104:H4 str. C236-11; identical to SEQ ID NO: 6340

SEQ ID NO: 18892 - protein, 249 aa, Escherichia coli O104:H4 str. C236-11; identical to SEQ ID NO: 6350

SEQ ID NO: 18893 - protein, 843 aa, Escherichia coli O104:H4 str. C236-11; identical to SEQ ID NO: 6288

SEQ ID NO: 18894 - protein, 228 aa, Escherichia coli O104:H4 str. C236-11; identical to SEQ ID NO: 6185

SEQ ID NO: 18895 - protein, 402 aa, Escherichia coli O104:H4 str. C236-11; identical to SEQ ID NO: 18029

SEQ ID NO: 18896 - protein, 243 aa, Escherichia coli O104:H4 str. C236-11; identical to SEQ ID NO: 6145

SEQ ID NO: 18897 - protein, 208 aa, Escherichia coli O104:H4 str. C236-11; identical to SEQ ID NO: 5717

SEQ ID NO: 18898 - protein, 614 aa, Escherichia coli O104:H4 str. C236-11; identical to SEQ ID NO: 6303

SEQ ID NO: 18899 - protein, 446 aa, Escherichia coli O104:H4 str. C236-11; identical to SEQ ID NO: 6312

SEQ ID NO: 18900 - protein, 237 aa, Escherichia coli O104:H4 str. C236-11; identical to SEQ ID NO: 6313

SEQ ID NO: 18901 - protein, 478 aa, Escherichia coli O104:H4 str. C236-11; identical to SEQ ID NO: 5711

SEQ ID NO: 18902 - protein, 209 aa, Escherichia coli O104:H4 str. C236-11; identical to SEQ ID NO: 18271

SEQ ID NO: 18903 - protein, 794 aa, Escherichia coli O104:H4 str. C236-11; identical to SEQ ID NO: 18204

SEQ ID NO: 18904 - protein, 246 aa, Escherichia coli O104:H4 str. LB226692; identical to SEQ ID NO: 6342

SEQ ID NO: 18905 - protein, 747 aa, Escherichia coli O104:H4 str. LB226692; identical to SEQ ID NO: 6343

SEQ ID NO: 18906 - protein, 266 aa, Escherichia coli O104:H4 str. LB226692; identical to SEQ ID NO: 5772

SEQ ID NO: 18907 - protein, 161 aa, Escherichia coli O104:H4 str. LB226692; identical to SEQ ID NO: 5769

SEQ ID NO: 18908 - protein, 784 aa, Escherichia coli O104:H4 str. LB226692; identical to SEQ ID NO: 6283

SEQ ID NO: 18909 - protein, 170 aa, Escherichia coli O104:H4 str. LB226692 [sequence omitted]

SEQ ID NO: 18910 - protein, 351 aa, Escherichia coli O104:H4 str. LB226692; identical to SEQ ID NO: 6282

SEQ ID NO: 18911 - protein, 230 aa, Escherichia coli O104:H4 str. LB226692; identical to SEQ ID NO: 6294

SEQ ID NO: 18912 - protein, 869 aa, Escherichia coli O104:H4 str. LB226692; identical to SEQ ID NO: 17935

SEQ ID NO: 18913 - protein, 746 aa, Escherichia coli O104:H4 str. LB226692; identical to SEQ ID NO: 6296

SEQ ID NO: 18914 - protein, 193 aa, Escherichia coli O104:H4 str. LB226692; identical to SEQ ID NO: 6300

SEQ ID NO: 18915 - protein, 430 aa, Escherichia coli O104:H4 str. LB226692; identical to SEQ ID NO: 5758

SEQ ID NO: 18916 - protein, 331 aa, Escherichia coli O104:H4 str. LB226692; identical to SEQ ID NO: 6456

SEQ ID NO: 18917 - protein, 760 aa, Escherichia coli O104:H4 str. LB226692; identical to SEQ ID NO: 6322

SEQ ID NO: 18918 - protein, 360 aa, Escherichia coli O104:H4 str. LB226692; identical to SEQ ID NO: 6315

SEQ ID NO: 18919 - protein, 203 aa, Escherichia coli O104:H4 str. LB226692; identical to SEQ ID NO: 6414

SEQ ID NO: 18920 - protein, 362 aa, Escherichia coli O104:H4 str. LB226692; identical to SEQ ID NO: 5809

SEQ ID NO: 18921 - protein, 233 aa, Escherichia coli O104:H4 str. LB226692; identical to SEQ ID NO: 6327

SEQ ID NO: 18922 - protein, 229 aa, Escherichia coli O104:H4 str. LB226692; identical to SEQ ID NO: 9369

SEQ ID NO: 18923 - protein, 729 aa, Escherichia coli O104:H4 str. LB226692; identical to SEQ ID NO: 6336

SEQ ID NO: 18924 - protein, 213 aa, Escherichia coli O104:H4 str. LB226692; identical to SEQ ID NO: 5744

SEQ ID NO: 18925 - protein, 203 aa, Escherichia coli O104:H4 str. LB226692; identical to SEQ ID NO: 6347

SEQ ID NO: 18926 - protein, 565 aa, Escherichia coli O104:H4 str. LB226692; identical to SEQ ID NO: 6395

SEQ ID NO: 18927 - protein, 207 aa, Escherichia coli O104:H4 str. LB226692; identical to SEQ ID NO: 5743

SEQ ID NO: 18928 - protein, 511 aa, Escherichia coli O104:H4 str. LB226692; identical to SEQ ID NO: 5749

SEQ ID NO: 18929 - protein, 232 aa, Escherichia coli O104:H4 str. LB226692; identical to SEQ ID NO: 5747

SEQ ID NO: 18930 - protein, 551 aa, Escherichia coli O104:H4 str. LB226692; identical to SEQ ID NO: 5742

SEQ ID NO: 18931 - protein, 700 aa, Escherichia coli O104:H4 str. LB226692; identical to SEQ ID NO: 6287

SEQ ID NO: 18932 - protein, 236 aa, Escherichia coli O104:H4 str. LB226692; identical to SEQ ID NO: 6472

SEQ ID NO: 18933 - protein, 118 aa, Escherichia coli O104:H4 str. LB226692 [sequence omitted]

SEQ ID NO: 18934 - protein, 111 aa, Escherichia coli O104:H4 str. LB226692; identical to SEQ ID NO: 7885

SEQ ID NO: 18935 - protein, 673 aa, Escherichia coli O104:H4 str. LB226692; identical to SEQ ID NO: 6298

SEQ ID NO: 18936 - protein, 826 aa, Escherichia coli O104:H4 str. LB226692; identical to SEQ ID NO: 6301

SEQ ID NO: 18937 - protein, 224 aa, Escherichia coli O104:H4 str. LB226692; identical to SEQ ID NO: 6302

SEQ ID NO: 18938 - protein, 463 aa, Escherichia coli O104:H4 str. LB226692
MKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 18939 - protein, 828 aa, Escherichia coli O104:H4 str. LB226692; identical to SEQ ID NO: 6308

SEQ ID NO: 18940 - protein, 162 aa, Escherichia coli O104:H4 str. LB226692; identical to SEQ ID NO: 5896

SEQ ID NO: 18941 - protein, 367 aa, Escherichia coli O104:H4 str. LB226692; identical to SEQ ID NO: 6310

SEQ ID NO: 18942 - protein, 200 aa, Escherichia coli O104:H4 str. LB226692; identical to SEQ ID NO: 6311

SEQ ID NO: 18943 - protein, 274 aa, Escherichia coli O104:H4 str. LB226692; identical to SEQ ID NO: 6316

SEQ ID NO: 18944 - protein, 250 aa, Escherichia coli O104:H4 str. LB226692; identical to SEQ ID NO: 6317

SEQ ID NO: 18945 - protein, 518 aa, Escherichia coli O104:H4 str. LB226692; identical to SEQ ID NO: 6358

SEQ ID NO: 18946 - protein, 432 aa, Escherichia coli O104:H4 str. LB226692; identical to SEQ ID NO: 5727

SEQ ID NO: 18947 - protein, 359 aa, Escherichia coli O104:H4 str. LB226692; identical to SEQ ID NO: 6332

SEQ ID NO: 18948 - protein, 686 aa, Escherichia coli O104:H4 str. LB226692; identical to SEQ ID NO: 6339

SEQ ID NO: 18949 - protein, 834 aa, Escherichia coli O104:H4 str. LB226692; identical to SEQ ID NO: 17975

SEQ ID NO: 18950 - protein, 249 aa, Escherichia coli O104:H4 str. LB226692; identical to SEQ ID NO: 6350

SEQ ID NO: 18951 - protein, 412 aa, Escherichia coli O104:H4 str. LB226692; identical to SEQ ID NO: 6284

SEQ ID NO: 18952 - protein, 231 aa, Escherichia coli O104:H4 str. LB226692; identical to SEQ ID NO: 6351

SEQ ID NO: 18953 - protein, 838 aa, Escherichia coli O104:H4 str. LB226692; identical to SEQ ID NO: 6352

SEQ ID NO: 18954 - protein, 678 aa, Escherichia coli O104:H4 str. LB226692; identical to SEQ ID NO: 6353

SEQ ID NO: 18955 - protein, 228 aa, Escherichia coli O104:H4 str. LB226692; identical to SEQ ID NO: 6185

SEQ ID NO: 18956 - protein, 243 aa, Escherichia coli O104:H4 str. LB226692; identical to SEQ ID NO: 6145

SEQ ID NO: 18957 - protein, 208 aa, Escherichia coli O104:H4 str. LB226692; identical to SEQ ID NO: 5717

SEQ ID NO: 18958 - protein, 614 aa, Escherichia coli O104:H4 str. LB226692; identical to SEQ ID NO: 6303

SEQ ID NO: 18959 - protein, 309 aa, Escherichia coli O104:H4 str. LB226692
MITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDTVRSPWATTGT

SEQ ID NO: 18960 - protein, 142 aa, Escherichia coli O104:H4 str. LB226692
MGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNGDSKVNPNYGKAVTADFNGGSFGRGDSDEWTFGAQMEIWW

SEQ ID NO: 18961 - protein, 237 aa, Escherichia coli O104:H4 str. LB226692; identical to SEQ ID NO: 6313

SEQ ID NO: 18962 - protein, 478 aa, Escherichia coli O104:H4 str. LB226692; identical to SEQ ID NO: 5711

SEQ ID NO: 18963 - protein, 731 aa, Escherichia coli O104:H4 str. LB226692; identical to SEQ ID NO: 17986

SEQ ID NO: 18964 - protein, 696 aa, Escherichia coli O104:H4 str. LB226692; identical to SEQ ID NO: 12728

SEQ ID NO: 18965 - protein, 774 aa, Escherichia coli O104:H4 str. LB226692; identical to SEQ ID NO: 18137

SEQ ID NO: 18966 - protein, 89 aa, Escherichia coli O104:H4 str. LB226692; identical to SEQ ID NO: 6233

SEQ ID NO: 18967 - protein, 236 aa, Escherichia coli O104:H4 str. LB226692; identical to SEQ ID NO: 18814

SEQ ID NO: 18968 - protein, 518 aa, Escherichia coli O111:H-; identical to SEQ ID NO: 6358

SEQ ID NO: 18969 - protein, 359 aa, Escherichia coli O111:H-; identical to SEQ ID NO: 6332

SEQ ID NO: 18970 - protein, 512 aa, Escherichia coli O111:H-; identical to SEQ ID NO: 6251

SEQ ID NO: 18971 - protein, 935 aa, Escherichia coli O111:H-
MITHGFYARTRHKHKLKKTFIMLSAGLGLFFYVNQNSFANGENYFKLSSDSKLLTQNVAQDRLFYTLKTGETVSSISKSQGISLSVIWSLNKHLYSSESEMLKAAPGQQIILPLKKLSVEYGALPVLGSAPVVAAGGVAGHTNKMTKMSPDATQSNMTDDRALNYTAQQAASLGSQLQSRSLHGDYAKDTALGIAGNQASSQLQAWLQHYGTAEVNLQSGNNFDGSSLDFLLPFYDSEKMLAFGQVGARYIDSRFTANLGAGQRFFLPENMLGYNVFIDQDFSGDNTRLGIGGEYWRDYFKSSVNGYFRMSGWHESYNKKDYDERPANGFDIRFNGYLPSYPALGAKLMYEQYYGDNVALFNSDKLQSNPGAATVGVNYTPIPLVTMGIDYRHGTGYENDLLYSMQFRYQFDKPWSPQIEPQYVNELRTLSGSRYDLVQRNNNIILEYKKQDILSLNIPHDINGTEHSTQKIQLIVKSKYGLDRIVWDDSALRSQGGQIQHSGSQSAQDYQAILPAYVQGGSNIYKVTARAYDRNGNSSNNVQLTITVLSNGQVVDQVGVTDFTADKTSAKADGTEAITYTATVKKNGVTQANVPVSFNIVSGTATLGANSATTDANGKATVTLKSSTPGQVVVSAKTAEMTSALNASAVIFVEQTKASITEIKADKTTAVANGNDAVTYTVKVMKEGQPVHGHSVAFTTNFGMFNGKSQTQNATTGSDGRATITLTSSSAGKATVSATVSGGNDVKAPEVTFFDGLKIDNKVDILGKNVTGDLPNIWLQYGQFKLKVSGGNGTYSWHSENTNIATVDESGKVTLKGKGTAVINVTSGDKQTVSYTIKAPNYMIRVGNKASYANAMSFCGNLLPSSQTVLSNVYNSWGPANGYDHYRSMQSITAWITQTEADKISGVSTTYDLITQNPHKDVSLNAPNVYAVCVE

SEQ ID NO: 18972 - protein, 552 aa, Escherichia coli O111:H-
MKLGRYSLFLLCPLLASCSGNGFYKDNLGVIDKNILHADTSLLKSKNKEHYKSSDMVSKTDSIYIGNSSFQTYHGEPLPGKLEGVHGIILRSSTPLGFDEVLSMIQDSSGIPIVKHTTKDVISGGVSSKSLAATVAEKMNSATGGKSTDQFDHLLLEVSSEHQLMDVNYQGALSTFLDKVAANYNLYWTYESGRIAFSNEETKRFSISILPGGKYTSKNSISSDSNSSSGSSGSSGSSSSDSGAELKFDSDVDFWKDIENSIKLILGSDGSYSISTSTSSVIVRTSSANMKKINEYINTLNAQLERQVTIDVAIYNVTTTDSSDLAMSLEALLKHNGGVLGSVSTSNFAATSGTPSFTGYLNGNGDSSNQVLLNLLAEKGKVSVVTSASVTTMSGQPVPLKVGNDRTYVSEIGTVLSQSSTSTTASTSTVTSGFLMNLLPQVADDGNILLQYGVTLSELVGSNNGFDQATVNGTVIQLPNVDSTTFVQSSMLRNGNTLVLAGYEKKRNESVDQGVGTTSFKLLGGALNGSASRTVTVICITPRIIDLKASGE

SEQ ID NO: 18973 - protein, 118 aa, Escherichia coli O111:H- [sequence omitted]

SEQ ID NO: 18974 - protein, 407 aa, Escherichia coli O111:H-
  strain 11128 / EHEC
MTERELSIIRALGEEFSTVLADLQRTFEGKMAAQAQAFEEKLASLSAVLQKHVTVDEVHPVLQAMVDDAVGTIPVPRDGRDYDPDVLQQAVNDAVANIPVPADGKSITPDDVRPMLEQMVKEAVSHIPAPRDGRDYDPEVLKQAVNDAVANIPVPADGKSITPDDVRPMLEQMVKEAVSHIPAPRDGCDYDPEVLKQAVNDAVANIPVPADGKSITPDDVRPMLEQMVKEAVSHIPAPRDGRDYDPEVLKQAVLEAVNALPAPQDGRDATALEVLPAIDDQKSFPRGTYATHLGGLWRAYEKTHGMRGWECLVDGVADIDVSMTDERLFSVVIRQSSGQCTEKTFSLPVMLYRGVFRAGKTYHPGDTVTWGGSLWHCNSMTGDKPGEAHSSGWTLAAKRGRDAGGGK

SEQ ID NO: 18975 - protein, 89 aa, Escherichia coli O111:H-; identical to SEQ ID NO: 6177
  strain 11128 / EHEC

SEQ ID NO: 18976 - protein, 387 aa, Escherichia coli O111:H-; identical to SEQ ID NO: 7356
  strain 11128 / EHEC

SEQ ID NO: 18977 - protein, 334 aa, Escherichia coli O111:H-; identical to SEQ ID NO: 7357
  strain 11128 / EHEC

SEQ ID NO: 18978 - protein, 826 aa, Escherichia coli O111:H-; identical to SEQ ID NO: 13378
  strain 11128 / EHEC

SEQ ID NO: 18979 - protein, 224 aa, Escherichia coli O111:H-; identical to SEQ ID NO: 6435
  strain 11128 / EHEC

SEQ ID NO: 18980 - protein, 663 aa, Escherichia coli O111:H-; identical to SEQ ID NO: 6307
  strain 11128 / EHEC

SEQ ID NO: 18981 - protein, 828 aa, Escherichia coli O111:H-; identical to SEQ ID NO: 7891
  strain 11128 / EHEC

SEQ ID NO: 18982 - protein, 162 aa, Escherichia coli O111:H-; identical to SEQ ID NO: 5896
  strain 11128 / EHEC

SEQ ID NO: 18983 - protein, 363 aa, Escherichia coli O111:H-; identical to SEQ ID NO: 7893
  strain 11128 / EHEC

SEQ ID NO: 18984 - protein, 200 aa, Escherichia coli O111:H-; identical to SEQ ID NO: 6311
  strain 11128 / EHEC

SEQ ID NO: 18985 - protein, 274 aa, Escherichia coli O111:H-; identical to SEQ ID NO: 7895
  strain 11128 / EHEC

SEQ ID NO: 18986 - protein, 250 aa, Escherichia coli O111:H-; identical to SEQ ID NO: 7896
  strain 11128 / EHEC

SEQ ID NO: 18987 - protein, 881 aa, Escherichia coli O111:H-; identical to SEQ ID NO: 9190
  strain 11128 / EHEC

SEQ ID NO: 18988 - protein, 472 aa, Escherichia coli O111:H-; identical to SEQ ID NO: 5729
  strain 11128 / EHEC

SEQ ID NO: 18989 - protein, 89 aa, Escherichia coli O111:H-; identical to SEQ ID NO: 6232
  strain 11128 / EHEC

SEQ ID NO: 18990 - protein, 432 aa, Escherichia coli O111:H-; identical to SEQ ID NO: 5727
  strain 11128 / EHEC

SEQ ID NO: 18991 - protein, 359 aa, Escherichia coli O111:H-; identical to SEQ ID NO: 5847
  strain 11128 / EHEC

SEQ ID NO: 18992 - protein, 551 aa, Escherichia coli O111:H-
  strain 11128 / EHEC
MPIGNLGNNVNSNNLIPPAPPLPSQTDGASRGGAGQLINSTGALGSRLLFSPLRNSIADSVDSRDIPGLPVHPSRLATATSEICLLGGFEVLHDKGPLDTLNKQIGASAFRIEQQSDGSYAAIGEKNGVEVSVILNSQELQSLQAIDIEDKGRFVFTGGRGGGGHSMVTPASDIAEARAKILAKLDPNNHGGSQARNVDTRSVGVGSASGMDDSVVSETRTSSTASSVRSDPKFWVSIGAIAAGLAGLAATGITQALALTPEPDDPTTTDPEQAASAAESATRDQLTQEAFKNPENQKVSIDEIGNSIPSGELKDDVVAKIEEQAKEAGEAARQQAVESNAQAQQRYDTQYARRQEELELSSGIGYSLSSALIVGGGIGAGVTTALHRRNQPAEQTTTTTTHTVVQQQTGGNTPAQGGTDAIRAEDTSLNRRDSQRSTASTHWSDTSSAVVNPYAEVGEARNSSPARQAEEHIYDEVAADPNYSVIQNFSGNNQVTGRLMGTPGQGIQSTYAILTNNSAGLRLGMGGLTGSGGSAVNTANAAPTPGPGRFV

SEQ ID NO: 18993 - protein, 512 aa, Escherichia coli O111:H-; identical to SEQ ID NO: 5697
  strain 11128 / EHEC

SEQ ID NO: 18994 - protein, 686 aa, Escherichia coli O111:H-; identical to SEQ ID NO: 6453
  strain 11128 / EHEC

SEQ ID NO: 18995 - protein, 834 aa, Escherichia coli O111:H-; identical to SEQ ID NO: 7903
  strain 11128 / EHEC

SEQ ID NO: 18996 - protein, 231 aa, Escherichia coli O111:H-; identical to SEQ ID NO: 6351
  strain 11128 / EHEC

SEQ ID NO: 18997 - protein, 838 aa, Escherichia coli O111:H-; identical to SEQ ID NO: 7363
  strain 11128 / EHEC

SEQ ID NO: 18998 - protein, 678 aa, Escherichia coli O111:H-; identical to SEQ ID NO: 6353
  strain 11128 / EHEC

SEQ ID NO: 18999 - protein, 784 aa, Escherichia coli O111:H-; identical to SEQ ID NO: 7852
  strain 11128 / EHEC

SEQ ID NO: 19000 - protein, 170 aa, Escherichia coli O111:H- [sequence omitted]

SEQ ID NO: 19001 - protein, 866 aa, Escherichia coli O111:H-; identical to SEQ ID NO: 13413
  strain 11128 / EHEC

SEQ ID NO: 19002 - protein, 246 aa, Escherichia coli O111:H-; identical to SEQ ID NO: 6342
  strain 11128 / EHEC

SEQ ID NO: 19003 - protein, 747 aa, Escherichia coli O111:H-; identical to SEQ ID NO: 6343
  strain 11128 / EHEC

SEQ ID NO: 19004 - protein, 266 aa, Escherichia coli O111:H-; identical to SEQ ID NO: 5772
  strain 11128 / EHEC

SEQ ID NO: 19005 - protein, 161 aa, Escherichia coli O111:H-; identical to SEQ ID NO: 5769
  strain 11128 / EHEC

SEQ ID NO: 19006 - protein, 366 aa, Escherichia coli O111:H-
  strain 11128 / EHEC
MQNWIKAAVIAVSLALPGVALAQSLESLVNVQGVRENQLVGYSLVVGLDGTGDKNQVKFTNQTITNMLRQFGVQLPNKIDPKVKNVAAVAVSATLPPMYSRGQTIDVTVSSIGDAKSIRGGTLLLTQLHGADGEVYALAQGSVVVGGMNATGASGSSVTVNTPTAGLIPNGATVEREIPSDFQMGDTITLNLKRPSFKDANNIAAAINASFGGIATAQSSTNVTVRAPTSPGARVAFMSQLDDVQVQAEKIRARVVFNSRTGTVVMGDGVALHAAAVSHGSLTVSINETSNVSQPNAFAGGRTAVTPQSNIAVNHARPGVVSLPESSSLKTLVNALNSLGATPDDIMSILQALHEAGALDADLEVI

SEQ ID NO: 19007 - protein, 412 aa, Escherichia coli O111:H-; identical to SEQ ID NO: 6495
  strain 11128 / EHEC

SEQ ID NO: 19008 - protein, 843 aa, Escherichia coli O111:H-; identical to SEQ ID NO: 7909
  strain 11128 / EHEC

SEQ ID NO: 19009 - protein, 228 aa, Escherichia coli O111:H-; identical to SEQ ID NO: 6185
  strain 11128 / EHEC

SEQ ID NO: 19010 - protein, 351 aa, Escherichia coli O111:H-; identical to SEQ ID NO: 6367
  strain 11128 / EHEC

SEQ ID NO: 19011 - protein, 243 aa, Escherichia coli O111:H-; identical to SEQ ID NO: 6145
  strain 11128 / EHEC

SEQ ID NO: 19012 - protein, 230 aa, Escherichia coli O111:H-; identical to SEQ ID NO: 7861
  strain 11128 / EHEC

SEQ ID NO: 19013 - protein, 869 aa, Escherichia coli O111:H-; identical to SEQ ID NO: 7862
  strain 11128 / EHEC

SEQ ID NO: 19014 - protein, 746 aa, Escherichia coli O111:H-; identical to SEQ ID NO: 6296
  strain 11128 / EHEC

SEQ ID NO: 19015 - protein, 193 aa, Escherichia coli O111:H-; identical to SEQ ID NO: 7864
  strain 11128 / EHEC

SEQ ID NO: 19016 - protein, 243 aa, Escherichia coli O111:H-; identical to SEQ ID NO: 6463
  strain 11128 / EHEC

SEQ ID NO: 19017 - protein, 816 aa, Escherichia coli O111:H-; identical to SEQ ID NO: 6462
  strain 11128 / EHEC

SEQ ID NO: 19018 - protein, 430 aa, Escherichia coli O111:H-; identical to SEQ ID NO: 5758
  strain 11128 / EHEC

SEQ ID NO: 19019 - protein, 208 aa, Escherichia coli O111:H-; identical to SEQ ID NO: 5717
  strain 11128 / EHEC

SEQ ID NO: 19020 - protein, 614 aa, Escherichia coli O111:H-; identical to SEQ ID NO: 7913
  strain 11128 / EHEC

SEQ ID NO: 19021 - protein, 446 aa, Escherichia coli O111:H-; identical to SEQ ID NO: 6459
  strain 11128 / EHEC

SEQ ID NO: 19022 - protein, 332 aa, Escherichia coli O111:H-; identical to SEQ ID NO: 6321
  strain 11128 / EHEC

SEQ ID NO: 19023 - protein, 760 aa, Escherichia coli O111:H-; identical to SEQ ID NO: 7873
  strain 11128 / EHEC

SEQ ID NO: 19024 - protein, 225 aa, Escherichia coli O111:H-
  strain 11128 / EHEC
MLLQSDHKQNKPGYKSEHNAFAGLLKHECGGALVRKFHVASGKTYQYHVCANARDGKCNVTKNFKNIEVALYQIMKELKLEKKTSFDKTLLEERNSVKTKIQELNNMLLELPKVPLSVLQTINNLEEKLQELEEKIKHQDNIIASEKTFNINTLREIKDPQQLNMMLKRVIENIIVFNIGKRWRIKILYRNKHSQSFIWDGSNITFVSDTKKLLELVKHTPEESK

SEQ ID NO: 19025 - protein, 204 aa, Escherichia coli O111:H-; identical to SEQ ID NO: 5755
  strain 11128 / EHEC

SEQ ID NO: 19026 - protein, 362 aa, Escherichia coli O111:H-; identical to SEQ ID NO: 5809
  strain 11128 / EHEC

SEQ ID NO: 19027 - protein, 233 aa, Escherichia coli O111:H-; identical to SEQ ID NO: 6327
  strain 11128 / EHEC

SEQ ID NO: 19028 - protein, 866 aa, Escherichia coli O111:H-; identical to SEQ ID NO: 6328
  strain 11128 / EHEC

SEQ ID NO: 19029 - protein, 236 aa, Escherichia coli O111:H-
  strain 11128 / EHEC
MTNTWNRLTLLIFAVLSLLVAGELRAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQLSVNGKALSNAGVVPPKSQRQTSWCQAIAPCHVAWRAINDYGGLSAKKEQNLP

SEQ ID NO: 19030 - protein, 237 aa, Escherichia coli O111:H-; identical to SEQ ID NO: 6384
  strain 11128 / EHEC

SEQ ID NO: 19031 - protein, 478 aa, Escherichia coli O111:H-; identical to SEQ ID NO: 5711
  strain 11128 / EHEC

SEQ ID NO: 19032 - protein, 696 aa, Escherichia coli O111:H-; identical to SEQ ID NO: 6320
  strain 11128 / EHEC

SEQ ID NO: 19033 - protein, 731 aa, Escherichia coli O111:H-; identical to SEQ ID NO: 8961
  strain 11128 / EHEC

SEQ ID NO: 19034 - protein, 368 aa, Escherichia coli O111:H-; identical to SEQ ID NO: 7849
  strain 11128 / EHEC

SEQ ID NO: 19035 - protein, 241 aa, Escherichia coli O111:H-; identical to SEQ ID NO: 6134
  strain 11128 / EHEC

SEQ ID NO: 19036 - protein, 917 aa, Escherichia coli O111:H-
  strain 11128 / EHEC
MSYLNLRLYQRNTQCLHIRKHRLAGFFVRLFVACAFAAQTPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLVNRPGFPGECFICELRLPDHRFRWKHNKLFLLLPEEYGPAFPAIVDCYTSPPTLVWPVPLLHGFSSSYGVLPPLCKDH

SEQ ID NO: 19037 - protein, 511 aa, Escherichia coli O111:H-; identical to SEQ ID NO: 5749
  strain 11128 / EHEC

SEQ ID NO: 19038 - protein, 191 aa, Escherichia coli O111:H-; identical to SEQ ID NO: 5748
  strain 11128 / EHEC

SEQ ID NO: 19039 - protein, 232 aa, Escherichia coli O111:H-; identical to SEQ ID NO: 5747
  strain 11128 / EHEC

SEQ ID NO: 19040 - protein, 365 aa, Escherichia coli O111:H-; identical to SEQ ID NO: 6335
  strain 11128 / EHEC

SEQ ID NO: 19041 - protein, 729 aa, Escherichia coli O111:H-
  strain 11128 / EHEC
MLSTQFNRDNQYQASTKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQHIDVNSPTWGGLPRWNTDGSSNSYDRARSTAPDWAYNDKEINKVFMTLKQRFADTWQATLNATHSEVEFDSKMMYVDAYVNKADGMLIGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWKNRVYTDTVTPYGTFRAEQGSYALVDLFTRYQVTKNFSLQGNVNNLFDKTYDTNVEGSIVYGAPRNFSITGTYQF

SEQ ID NO: 19042 - protein, 213 aa, Escherichia coli O111:H-; identical to SEQ ID NO: 5744
  strain 11128 / EHEC

SEQ ID NO: 19043 - protein, 461 aa, Escherichia coli O111:H-
  strain 11128 / EHEC
MTERELSIIRALGEEFSTVLADLQRTFEGKMASQAQAFEEKLASLSAVLQKHVTVDEVHPVLQAMVDDAVGTIPVPRDGRDYDPDVLQQAVNDAVANIPVPADGKSITPDDVRPMLEQMVKEAVSHIPAPRDGRDYDPEVLKQAVNDAVANIPVPADGKSITPDDVRPMLEQMVKEAVSHIPAPRDGRDYDPEVLKQAVNDAVANIPVPADGKSITPDDVRPMLEQMVKEAVSHIPVPRDGRDYDPEVLQKAVNDAVANIPVPADGKSITPDDVRPMLEQMVKEAVSHIPVPRDGRDYDPDVLQKAVLDAVRALPAPQDGRDATALEIIPAIDDQKSFPRGTYATHLGGLWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRDAGGGK

SEQ ID NO: 19044 - protein, 203 aa, Escherichia coli O111:H-; identical to SEQ ID NO: 6347
  strain 11128 / EHEC

SEQ ID NO: 19045 - protein, 565 aa, Escherichia coli O111:H-; identical to SEQ ID NO: 6492
  strain 11128 / EHEC

SEQ ID NO: 19046 - protein, 207 aa, Escherichia coli O111:H-; identical to SEQ ID NO: 5743
  strain 11128 / EHEC

SEQ ID NO: 19047 - protein, 859 aa, Escherichia coli O111:H-
  strain 11128 / EHEC
MWNLLRRTRKNQKSGRDVREAGWTSLFQAVAEPFSGAWQQGVKADPEAVLSFHAVFACISLISQDIAKMRLRLMQTDAHGIRRETRRGDIARLCRRPNAQQNRIQFFELWLNAKLRHGNTVVLKIRNARGQIKELRILDWSRVEPLVADDGEVFYRITPDRNCGITEAVTVPAREVIHDRFNCFFHPLVGLPPVYAAGLAATQGHHIQENSTSFFRNGGRPSGVIEIPGSITEENAKKLKSNWDSGYTGENAGKTAILSNGAKYNPTTFSPVDAQTVEQLKMTAEIVCSVFRVPAYKIGVGQPPSSDNVEALEQQYYSQCLQTLIESIELLLDEALETGENESTEFDVTTLLRMDSERRMKTLGDAVKNTLLTPNEARKRENLPPLAGGDALYLQQQNYSLEALSRRDAREDPFASAGKTVSAQLPDGASDGNKAISETEHDAVKAMFRGDTEKMTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLKQAVNDAVANIPQPADGKSLTPDDVRPMLEQMVKEAVSHIPVPRDGRDYDPDVLQKAVNDAVANIPQPADGKSLTPDDVRPMLEQMVKEAVSHIHVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 19048 - protein, 551 aa, Escherichia coli O111:H-; identical to SEQ ID NO: 5742
  strain 11128 / EHEC

SEQ ID NO: 19049 - protein, 700 aa, Escherichia coli O111:H-; identical to SEQ ID NO: 13443
  strain 11128 / EHEC

SEQ ID NO: 19050 - protein, 883 aa, Escherichia coli O111:H-
  strain 11128 / EHEC
MTAFRAAFKAYRMHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKIALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTIFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVITVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 19051 - protein, 236 aa, Escherichia coli O111:H-; identical to SEQ ID NO: 6472
  strain 11128 / EHEC

SEQ ID NO: 19052 - protein, 353 aa, Escherichia coli O111:H-
  strain 11128 / EHEC
MTERELSIIRALGEEFSTVLADLQRTFEGKMAAQAQAFEEKLASLSAVLQKHVTVDEVHPVLQAMVDDAVGTIPVPRDGRDYDPDVLQQAVNDAVANIPVPADGKSITPDDVRPMLEQMVKEAVSHIPAPRDGRDYDPEVLKQAVNDAVANIPVPADGKSITPDDVRPMLEQMVKEAVSHIPVPRDGRDYDPDVLQKAVLDAVRALPAPQDGRDATALEIIPAIDDQKSFPRGTYATHQGGLWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRDAGGGK

SEQ ID NO: 19053 - protein, 998 aa, Escherichia coli O111:H-; identical to SEQ ID NO: 13410
  strain 11128 / EHEC

SEQ ID NO: 19054 - protein, 119 aa, Escherichia coli O111:H-; identical to SEQ ID NO: 5986
  strain 11128 / EHEC

SEQ ID NO: 19055 - protein, 89 aa, Escherichia coli O111:NM; identical to SEQ ID NO: 6233

SEQ ID NO: 19056 - protein, 89 aa, Escherichia coli O111:NM; identical to SEQ ID NO: 6232

SEQ ID NO: 19057 - protein, 87 aa, Escherichia coli O115:HMN
MKKMIIAVLFGLFSANSMAADCAVGKIEFSKYNEDNTFTVRVSGREYWTNRWNLQPLLQSAQLTGMTVTIISNTCSSGSGFAQVKFN

SEQ ID NO: 19058 - protein, 826 aa, Escherichia coli O127:H6; identical to SEQ ID NO: 7836
  strain E2348/69 / EPEC

SEQ ID NO: 19059 - protein, 663 aa, Escherichia coli O127:H6
  strain E2348/69 / EPEC
MFRLNPFVRVGLCLSAISCAWPVLAVDDDGETMVVTASSVEQNLKDAPASISVITQEDLQRKPVQNLEDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKIENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 19060 - protein, 828 aa, Escherichia coli O127:H6; identical to SEQ ID NO: 7820
  strain E2348/69 / EPEC

SEQ ID NO: 19061 - protein, 162 aa, Escherichia coli O127:H6; identical to SEQ ID NO: 5896
  strain E2348/69 / EPEC

SEQ ID NO: 19062 - protein, 371 aa, Escherichia coli O127:H6; identical to SEQ ID NO: 7822
  strain E2348/69 / EPEC

SEQ ID NO: 19063 - protein, 200 aa, Escherichia coli O127:H6; identical to SEQ ID NO: 5898
  strain E2348/69 / EPEC

SEQ ID NO: 19064 - protein, 274 aa, Escherichia coli O127:H6; identical to SEQ ID NO: 5899
  strain E2348/69 / EPEC

SEQ ID NO: 19065 - protein, 249 aa, Escherichia coli O127:H6; identical to SEQ ID NO: 7817
  strain E2348/69 / EPEC

SEQ ID NO: 19066 - protein, 879 aa, Escherichia coli O127:H6
  strain E2348/69 / EPEC
MPEHSFLRLRGLSWWIALAISGSPFNALADDTIQFDGRFLDLKGNTKIDLGRFSQKGYVEPGKYNLRVHVNNQPLPDDYDIYWYATENDPNKSYACLSPELVAQFGLKEDIAKNLQWIRDGQCLNTALLAGTEISGDLGQSALLVSVPQAYLEYTDSEWDPPSRWDDGIPGLIADYSINAQTRHENGGDDTNDISGNGTVGVNVGPWRLRADWQSDYQHTRSNDDGDTDDSGTQKNWEWSRYYAWRALPSLKAKLSLGEDYLNSDIFDGFSYIGGSISTDDQMLPPNLRGYAPDISGVAHTTAKVTVTQMGRVIYETQVPAGPFRIQDIGDSVSGTLHVRIEEQNGQVQEYDVSTASMPFLTRPGQVRYKVTMGRPQNWDHQVAGSFFSGGEASWGIANGWSLYGGALADENYQSAALGLGRDLALLGALAFDVTHSRVQLDDNSVYGNKTLDGNSYRVSYAKDFDELNSRVTFAGYRFSEKNYMTMSEYLDANDDDRARTGNDKEMYMVTYNQNFTDARVSVYLNYSHHTYWDRQDQTNYNMMLSHYFNLGSLRNLSVSLTGYRYEYDKSADKGVYLSLSLPWGDNSTISYNGNYGSGADSNQVSLYHRIDDASHYTLSAGTSENHSSVDGYYSHDGTLAKVDLSANYHEGQYTSAGISLQGGATLTAHGGALHRTQNMGGTRLLIDADGVANVPVEGNGSAVYTNMFGKAVVADVNDYYRNQAYIDLNKLPENAEATKSVVQATLTEGAIGYRKFAVISGEKAMAVLRLQDGSHPPFGAEVKNDNQQQVGLVDDEGNVYLAGVKPGEHMTVFWEGESHCDISLPDPLPNDLFNGLLLPCQQKGGSSPVIPHDIQPVIQEQTQQVTPMEPPMSVSSNQ

SEQ ID NO: 19067 - protein, 472 aa, Escherichia coli O127:H6; identical to SEQ ID NO: 7376
  strain E2348/69 / EPEC

SEQ ID NO: 19068 - protein, 505 aa, Escherichia coli O127:H6; identical to SEQ ID NO: 14677
  strain E2348/69 / EPEC

SEQ ID NO: 19069 - protein, 432 aa, Escherichia coli O127:H6; identical to SEQ ID NO: 5727
  strain E2348/69 / EPEC

SEQ ID NO: 19070 - protein, 359 aa, Escherichia coli O127:H6; identical to SEQ ID NO: 5847
  strain E2348/69 / EPEC

SEQ ID NO: 19071 - protein, 686 aa, Escherichia coli O127:H6; identical to SEQ ID NO: 7831
  strain E2348/69 / EPEC

SEQ ID NO: 19072 - protein, 784 aa, Escherichia coli O127:H6; identical to SEQ ID NO: 16516
  strain E2348/69 / EPEC

SEQ ID NO: 19073 - protein, 170 aa, Escherichia coli O127:H6; identical to SEQ ID NO: 7801
  strain E2348/69 / EPEC

SEQ ID NO: 19074 - protein, 862 aa, Escherichia coli O127:H6
  strain E2348/69 / EPEC
MTIKSTNHLTHIATFCALLYSNSALCAELVEYDHTFLMGNDASNIDLSRYTEGNPTLPGIYDVSVYINDQPIMSQSIAFTVIEGKKNAQACITQKNLLQFHISSPDKNSGKAILLKRDDDLGDCLNLAEMISQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLDTDHRSSGFQSIDTQLNSDFKGNNQLNISSSGYSDTNRISYSVNTGYMMNKSSDDLSYIGGHASYESPWGTLSCSASASSDNSRQFSLNTDGGFVLHSGGLTFSNDSFSDSDTLAVIQALGAKGARINYGNSTVDRWSYGVTSALSPYHENRIALDINDLENDVELKSTSTVAIPRQGAVVFADFETVQGQSAIMNIVRSDGKNIPFAEDIYDEQNNIIGNVGQGGQAFVHGIEQEENIRITWIEEGKPVSCFAHYQQNTASEKIAQSIILNGLRCQIQ

SEQ ID NO: 19075 - protein, 731 aa, Escherichia coli O127:H6; identical to SEQ ID NO: 10965
  strain E2348/69 / EPEC

SEQ ID NO: 19076 - protein, 266 aa, Escherichia coli O127:H6; identical to SEQ ID NO: 7806
  strain E2348/69 / EPEC

SEQ ID NO: 19077 - protein, 810 aa, Escherichia coli O127:H6; identical to SEQ ID NO: 6345
  strain E2348/69 / EPEC

SEQ ID NO: 19078 - protein, 161 aa, Escherichia coli O127:H6
  strain E2348/69 / EPEC
MKKWLLAAGLGLALATSAQAADKIAIVNMGSLFQQVAQKTGVSNTLENEFKGRASELQRMETDLQAKMKKLQSMKAGSDRTKLEKDVMAQRQTFAQKAQAFEQDRARRSNEERGKLVTRIQTAVKSVANSQDIDLVVNANAVAYNSSDVKDITADVLKQVK

SEQ ID NO: 19079 - protein, 713 aa, Escherichia coli O127:H6; identical to SEQ ID NO: 11059
  strain E2348/69 / EPEC

SEQ ID NO: 19080 - protein, 222 aa, Escherichia coli O127:H6; identical to SEQ ID NO: 8389
  strain E2348/69 / EPEC

SEQ ID NO: 19081 - protein, 678 aa, Escherichia coli O127:H6; identical to SEQ ID NO: 7829
  strain E2348/69 / EPEC

SEQ ID NO: 19082 - protein, 351 aa, Escherichia coli O127:H6; identical to SEQ ID NO: 7789
  strain E2348/69 / EPEC

SEQ ID NO: 19083 - protein, 412 aa, Escherichia coli O127:H6; identical to SEQ ID NO: 11006
  strain E2348/69 / EPEC

SEQ ID NO: 19084 - protein, 746 aa, Escherichia coli O127:H6; identical to SEQ ID NO: 6783
  strain E2348/69 / EPEC

SEQ ID NO: 19085 - protein, 193 aa, Escherichia coli O127:H6; identical to SEQ ID NO: 6300
  strain E2348/69 / EPEC

SEQ ID NO: 19086 - protein, 660 aa, Escherichia coli O127:H6; identical to SEQ ID NO: 10888
  strain E2348/69 / EPEC

SEQ ID NO: 19087 - protein, 859 aa, Escherichia coli O127:H6; identical to SEQ ID NO: 10831
  strain E2348/69 / EPEC

SEQ ID NO: 19088 - protein, 217 aa, Escherichia coli O127:H6
  strain E2348/69 / EPEC
MLISQSALASGVGLSSTRVIYDGNKKEASLTVQNKNKSEEFLIQSWVDDATGSKKTPFIITPPLFKLEPGKNNILRIVNVNPSLPQDRESVYWVNVKAIPSQNEENEGKNVLQIAVRTRIKLFYRPAGLKGDIKSSPGELRFTRNGKQIKVDNPTVFNITFSDVFINGHEIEKSGMVPAKGALNIYLPAGVNSASQIKYNTINDFGSSGEYLTREIN

SEQ ID NO: 19089 - protein, 430 aa, Escherichia coli O127:H6; identical to SEQ ID NO: 5758
  strain E2348/69 / EPEC

SEQ ID NO: 19090 - protein, 332 aa, Escherichia coli O127:H6; identical to SEQ ID NO: 5757
  strain E2348/69 / EPEC

SEQ ID NO: 19091 - protein, 760 aa, Escherichia coli O127:H6
  strain E2348/69 / EPEC
MENNRNFPARQFHSLTFFAGLCIGITPVAQALAAEGQANADDTLVVEASTPSLYAPQKSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRNKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPASVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 19092 - protein, 550 aa, Escherichia coli O127:H6
  strain E2348/69 / EPEC
MPIGNLGNNVNGNHLIPPAPPLPSQTDGAARGGTGHLISSTGALGSRSLFSPLRNSMADSVDSRDIPGLPTNPSRLAAATSETCLLGGFEVLHDKGPLDILNTQIGPSAFRVEVQADGTHAAIGEKNGLEVSVTLSPQEWSSLQSIDTEGKNRFVFTGGRGGSGHPMVTVASDIAEARTKILAKLDPDNHGGRQPKDVDTRSVGVGSASGIDDGVVSETHTSTTNSSVRSDPKFWVSVGAIAAGLAGLAATGIAQALALTPEPDDPTTTDPDQAANAAESATKDQLTQEAFKNPENQKVNIDANGNAIPSGELKDDIVEQIAQQAKEAGEVARQQAVESNAQAQQRYEDQHARRQEELQLSSGIGYGLSSALIVAGGIGAGVTTALHRRNQPAEQTTTTTTHTVVQQQTGGNTPAQGGTDATRAEDASLNRRDSQGSVASTHWSDSSSEVVNPYAEVGGARNSLSAHQPEEHIYDEVAADPGYSVIQNFSGSGPVTGRLIGTPGQGIQSTYALLANSGGLRLGMGGLTSGGESAVSSVNAAPTPGPVRFV

SEQ ID NO: 19093 - protein, 512 aa, Escherichia coli O127:H6; identical to SEQ ID NO: 6120
  strain E2348/69 / EPEC

SEQ ID NO: 19094 - protein, 204 aa, Escherichia coli O127:H6; identical to SEQ ID NO: 5755
  strain E2348/69 / EPEC

SEQ ID NO: 19095 - protein, 356 aa, Escherichia coli O127:H6
  strain E2348/69 / EPEC
MMKRNILAVVVPALLVAGTANAAEIYNKDGNKLDLYGKAVGLHYFSKGNGENSYGGNGDKTYARLGFKGETQINSDLTGYGQWEYNFQGNNSEGDDAQNGNKTRLAFAGLKFADAGSFDYGRNYGVVYDALGYTDMLPEFGGDTAYSDDFFVGRVGGVATYRNSNFFGLVDGLNFAVQYLGKNERDTARRSNGDGVGGSVSYEFEGFGIVGAYGAADRTNLQEDSTLGKGKKAEQWATGLKYDANNIYLAANYGETRNATPITGGFANKTQDILLVAQYQFDFGLRPSIAYTKSKAKDVEGIGDVDLVNYIEVGATYYFNKNMSTYVDYAINQIDSDNKLGVGSDDTVAVGIVYQF

SEQ ID NO: 19096 - protein, 511 aa, Escherichia coli O127:H6; identical to SEQ ID NO: 5749
  strain E2348/69 / EPEC

SEQ ID NO: 19097 - protein, 191 aa, Escherichia coli O127:H6; identical to SEQ ID NO: 5748
  strain E2348/69 / EPEC

SEQ ID NO: 19098 - protein, 232 aa, Escherichia coli O127:H6
  strain E2348/69 / EPEC
MQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGVFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 19099 - protein, 365 aa, Escherichia coli O127:H6
  strain E2348/69 / EPEC
MIKFLSALILLLVITAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINSRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 19100 - protein, 729 aa, Escherichia coli O127:H6; identical to SEQ ID NO: 7833
  strain E2348/69 / EPEC

SEQ ID NO: 19101 - protein, 213 aa, Escherichia coli O127:H6; identical to SEQ ID NO: 5744
  strain E2348/69 / EPEC

SEQ ID NO: 19102 - protein, 446 aa, Escherichia coli O127:H6; identical to SEQ ID NO: 5873
  strain E2348/69 / EPEC

SEQ ID NO: 19103 - protein, 237 aa, Escherichia coli O127:H6; identical to SEQ ID NO: 7546
  strain E2348/69 / EPEC

SEQ ID NO: 19104 - protein, 478 aa, Escherichia coli O127:H6; identical to SEQ ID NO: 6796
  strain E2348/69 / EPEC

SEQ ID NO: 19105 - protein, 203 aa, Escherichia coli O127:H6; identical to SEQ ID NO: 7809
  strain E2348/69 / EPEC

SEQ ID NO: 19106 - protein, 656 aa, Escherichia coli O127:H6; identical to SEQ ID NO: 7810
  strain E2348/69 / EPEC

SEQ ID NO: 19107 - protein, 565 aa, Escherichia coli O127:H6
  strain E2348/69 / EPEC
MKSPAPSRPQKMALIPACIFLCFAALSVQAEETSVTPQPPDILLGPLFNDVQNAKLFPDPKTFADAVPNSYPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILSRASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLMEKYDVSTTGTGGGGGEYPLQDGFGWTNGVTLKMLDLICPKEQPCDNVPATRPLSESTTQPLKQKEAEPTP

SEQ ID NO: 19108 - protein, 207 aa, Escherichia coli O127:H6; identical to SEQ ID NO: 7812
  strain E2348/69 / EPEC

SEQ ID NO: 19109 - protein, 368 aa, Escherichia coli O127:H6
  strain E2348/69 / EPEC
MNKTITALTIIMASFAANASVLPETPVPFKSGTGAIDNGTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTTIDKINAHYFDKKAEDYFFNKFLLSFDPSTQQWSYAGESPWYGTAGAAVVNKGDKTWLINGEAKPGLRTDAVFELDFTGNNLKWNKLAPVTSPDGVAGGFAGMSNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 19110 - protein, 241 aa, Escherichia coli O127:H6
  strain E2348/69 / EPEC
MSNKNVNVRKSQEITFCLLAGILMFMAMVVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTQVLENALVPPMGESTVKLPSDAGSNITYRTINDYGALTPKMTGVME

SEQ ID NO: 19111 - protein, 878 aa, Escherichia coli O127:H6
  strain E2348/69 / EPEC
MSYLNLRIYQRNTQCLHIRKHRLAVFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGSNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGAQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 19112 - protein, 861 aa, Escherichia coli O127:H6
  strain E2348/69 / EPEC
MWNLLRRTRKNQKSGRDVREVGWTSLFQAVAEPFSGAWQQGVKADPEAVLSFHAVFACISLISQDIAKMRLRLMQTDAHGIRRETRRGDIARLCRRPNAQQNRIQFFELWLNAKLRHGNTVVLKIRNARGQIKELRILDWSRVEPLVADDGEVFYRITPDRNCGITEAVTVPAREVIHDRFNCFFHPLIGLPPMYAAGLAATQGHHIQENSTSFFRNGGRPSGVIEIPGSITEENAKKLKSNWDSGYTGENAGKTAILSNGAKYNPTTFSPVDAQTVEQLKMTAEIVCSVFRVPAYKIGVGQPPSSDNVEALEQQYYSQCLQTLIESIELLLDEALETGENESTEFDVTTLLRMDSERRMKTLGDAVKNTLLTPNEARKRENLPPLAGGDALYLQQQNYSLEALSRRDAREDPFSSAGKTVSSQLPDGASDGNKAISETEHDAVKAMFRGDTEKMTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVNDAVANIPQPADGKSLTPDDVRPMLEQMVKEAVSHIHVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGGGK

SEQ ID NO: 19113 - protein, 551 aa, Escherichia coli O127:H6; identical to SEQ ID NO: 7843
  strain E2348/69 / EPEC

SEQ ID NO: 19114 - protein, 700 aa, Escherichia coli O127:H6; identical to SEQ ID NO: 10811
  strain E2348/69 / EPEC

SEQ ID NO: 19115 - protein, 883 aa, Escherichia coli O127:H6
  strain E2348/69 / EPEC
MTAFRAAFKAYRMHQVLLLPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSADKHAPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQITVPPGPFTIDDINSAANGGDLQVTIKEADGSIQTLYVPYSSVPVLQRAGYTCYALAMGEYRSGNNLQSSPKFIQGSLMHGLEGNWTPYGGMQIAENYQAFNLGIGKDLGLFGAFSFDITQANTTLADDTRHSGQSLKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYNMSNDLKGGMTNLSGVYGTLLPDNNLNYSVQVGNTHGGNTSSGTSGYSSLNYRGAYGNTNIGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPAVSPGTLLNQQTAICR

SEQ ID NO: 19116 - protein, 236 aa, Escherichia coli O127:H6
  strain E2348/69 / EPEC
MQTTRTPYSISFMATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKSTMQ

SEQ ID NO: 19117 - protein, 102 aa, Escherichia coli O127:H6; identical to SEQ ID NO: 7813
  strain E2348/69 / EPEC

SEQ ID NO: 19118 - protein, 118 aa, Escherichia coli O127:H6 [sequence omitted]

SEQ ID NO: 19119 - protein, 334 aa, Escherichia coli O127:H6
  strain E2348/69 / EPEC
MKKNQFLKESDVTAESVFFMKRRQVLKALGISAAALSLPHAAHADLLSWFKGNDRPPAPAGKPLEFSKPAAWQNNLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTSERPPTTWNLAAPDEYGFYANVNPHVDHPRWSQATERFIGSGGILDVQRQPTLLFNGYADQVASLYRGLDLRENF

SEQ ID NO: 19120 - protein, 121 aa, Escherichia coli O127:H6; identical to SEQ ID NO: 6059
  strain E2348/69 / EPEC

SEQ ID NO: 19121 - protein, 208 aa, Escherichia coli O127:H6; identical to SEQ ID NO: 5869
  strain E2348/69 / EPEC

SEQ ID NO: 19122 - protein, 939 aa, Escherichia coli O127:H6
  strain E2348/69 / EPEC
MITHGFYARTRHKHKLKKTFIMLSAGLGLFFYVNQNSFANGENYFKLGSDSKLLTHNSYQNRLFYTLKTGETVADLSKSQDINLSTIWSLNKHLYSSESEMMKAAPGQQIILPLKKLPFEYSALPLLGSAPLVAAGGVAGHTNKLTKMSPDVTKSNMTDDKALNYAAQQAASLGSQLQSRSLNGDYAKDTALGIAGNQASSQLQAWLQHYGTAEVNLQSGNNFDGSSLDFLLPFYDSEKMLAFGQVGARYIDSRFTANLGAGQRFFLPENMLGYNVFIDQDFSGDNTRLGIGGEYWRDYFKSSVNGYFRMSGWHESYNKKDYDERPANGFDIRFNGYLPSYPALGAKLMYEQYYGDNVALFNSDKLQSNPGAATVGVNYTPIPLVTMGIDYRHGTGNENDLLYSMQFRYQFDKPWSQQIEPQYVNELRTLSGSRYDLVQRNNNIILEYKKQDILSLNIPHDINGTERSTQKIQLIVKSKYGLDRIVWDDSALRSQGGQIQHSGSQSAQDYQAILPAYVQGGSNVYKVTARAYDRNGNSSNNVLLTITVLSNGQVVDQVGVTDFTADKTSAKADGTEAITYTATVKKNGVAQANVPVSFNIVSGTAVLSANSANTNGSGKATVTLKSDKPGQVVVSAKTAEMTSALNANAVIFVDQTKASITEIKADKTTAVANGQDAITYTVKVMKGDKPVSNQEVTFTTTLGKLSNSTEKTDTNGYAKVTLTSTTPGKSLVSARVSDVAVDVKAPEVEFFTTLTIDDGNIEIVGTGVKGKLPTVWLQYGQVNLKASGGNGKYTWRSANPAIASVDASSGQVTLKEKGTTTISVISSDNQTATYTIATPNSLIVPNMSKRVTYNDAVNTCKNFGGKLPSSQNELENVFKAWGAANKYEYYKSSQTIISWVQQTAQDAKSGVASTYDLVKQNPLNNIKASESNAYATCVK

SEQ ID NO: 19123 - protein, 552 aa, Escherichia coli O127:H6; identical to SEQ ID NO: 18972
  strain E2348/69 / EPEC

SEQ ID NO: 19124 - protein, 1305 aa, Escherichia coli O127:H6
  strain E2348/69 / EPEC
MNKIYALKYCHATGGLIAVSELASRVMKKAARGSLLALFNLSLYGAFLSASQAAQLNIDNVWARDYLDLAQNKGVFKAGATNVSIQLKNGQTFNFPNVPIPDFSPASNKGATTSIGGAYSVTATHNGTTHHAISTQNWGQSSYKYIDRMTNGDFAVTRLDKFVVETTGVKNSVDFSLNSHDALERYGVEINGEKKIIGFRVGAGTTYTVQNGNTYSTGQVYNPLLLSASMFQLNWDNKRPYNNTTPFYNETTGGDSGSGFYLYDNVKKEWVMLGTLFGIASSGADVWSILNQYDENTVNGLKNKFTQKVQLNNNTMSLNSDSFTLAGNNTAVEKNNNNYKDLSFSGGGSINFDNDVNIGSGGLIFDAGHHYTVTGNNKTFKGAGLDIGDNTTVDWNVKGVVGDNLHKIGAGTLNVNVSQGNNLKTGDGLVVLNSANAFDNIYMASGHGVVKINHSAALNQNNDYRGIFFTENGGTLDLNGYDQSFNKIAATDIGALITNSAVQKAVLSVNNQSNYMYHGSVSGNTEINHQFDTQKNNSRLILDGNVDITNDINIKNSQLTMQGHATSHAVFREGGVTCMLPGVICEKDYVSGIQQQENSANKNNNTDYKTNNQVSSFEQPDWENRLFKFKTLNLINSDFIVGRNAIVVGDISANNSTLSLSGKDTKVHIDMYDGKNITGDGFGFRQDIKDGVSVSPESSSYFGNVTLNNHSLLDIGNKFTGGIEAYDSSVSVTSQNAVFDRVGSFVNSSLTLEKGAKLTAQGGIFSTGAVDVKENASLILTGTPSAQKQEYYSPVISTTEGINLGDKASLSVKNMGYLSSDIHAGTTAATINLGDGDAETDSPLFSSLMKGYNAVLSGNITGEQSTVNMNNALWYSDGNSTIGTLKSTGGRVELGGGKDFATLRVKELNANNATFLMHTNNSQADQLNVTNKLLGSNNTVLVDFLNKPASEMNVTLITAPKGSDEKTFTAGTQQIGFSNVTPVISTEKTDDATKWMLTGYQTVSDAGASKTATDFMASGYKSFLTEVNNLNKRMGDLRDTQGDAGVWARIMNGTGSADGGYSDNYTHVQIGADRKHELDGVDLFTGALLTYTDSNASSHAFSGKTKSVGGGLYASALFDSGAYFDLIGKYLHHDNQYTASFASLGTKDYSSHSWYAGAEVGYRYHLSEESWVEPQMELVYGSVSGKSFSWEDRGMALSMKDKDYNPLIGRTGVDVGRTFSGDDWKITARAGLGYQFDLLANGETVLRDASGEKRFEGEKDSRMLMNVGMNAEIKDNMRFGLELEKSAFGKYNVDNAINANFRYSF

SEQ ID NO: 19125 - protein, 269 aa, Escherichia coli O139:H28
  strain E24377A / ETEC
MSSCMIYKFSSMKNITFIFFILLASPLYANGDKLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLRKYQSKVKRQIFSDYQSEVDIYNRIRDEL

SEQ ID NO: 19126 - protein, 241 aa, Escherichia coli O139:H28; identical to SEQ ID NO: 14650
  strain E24377A / ETEC

SEQ ID NO: 19127 - protein, 119 aa, Escherichia coli O139:H28; identical to SEQ ID NO: 6076
  strain E24377A / ETEC

SEQ ID NO: 19128 - protein, 784 aa, Escherichia coli O139:H28; identical to SEQ ID NO: 6283
  strain E24377A / ETEC

SEQ ID NO: 19129 - protein, 866 aa, Escherichia coli O139:H28
  strain E24377A / ETEC
MTIKPTKNYHNHLTRIATFCALLYCNSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKCLEESKPVSCLAHYQQSSEAEKIAQSIILNGIRCQIQ

SEQ ID NO: 19130 - protein, 246 aa, Escherichia coli O139:H28; identical to SEQ ID NO: 15375
  strain E24377A / ETEC

SEQ ID NO: 19131 - protein, 747 aa, Escherichia coli O139:H28; identical to SEQ ID NO: 6343
  strain E24377A / ETEC

SEQ ID NO: 19132 - protein, 266 aa, Escherichia coli O139:H28; identical to SEQ ID NO: 5772
  strain E24377A / ETEC

SEQ ID NO: 19133 - protein, 810 aa, Escherichia coli O139:H28; identical to SEQ ID NO: 6345
  strain E24377A / ETEC

SEQ ID NO: 19134 - protein, 161 aa, Escherichia coli O139:H28; identical to SEQ ID NO: 5769
  strain E24377A / ETEC

SEQ ID NO: 19135 - protein, 351 aa, Escherichia coli O139:H28; identical to SEQ ID NO: 5767
  strain E24377A / ETEC

SEQ ID NO: 19136 - protein, 230 aa, Escherichia coli O139:H28; identical to SEQ ID NO: 6294
  strain E24377A / ETEC

SEQ ID NO: 19137 - protein, 746 aa, Escherichia coli O139:H28; identical to SEQ ID NO: 7355
  strain E24377A / ETEC

SEQ ID NO: 19138 - protein, 193 aa, Escherichia coli O139:H28; identical to SEQ ID NO: 6300
  strain E24377A / ETEC

SEQ ID NO: 19139 - protein, 243 aa, Escherichia coli O139:H28; identical to SEQ ID NO: 6463
  strain E24377A / ETEC

SEQ ID NO: 19140 - protein, 833 aa, Escherichia coli O139:H28
  strain E24377A / ETEC
MAALSPPFIKYLSGMDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNISIPQAWLAWHSENWTPPSTWKEGVAGILMDYNLFASSYRPQDGSSSTNLNAYGTTGINAGAWRLRSDYQLNQTDSDDNHEQSGGISRTYLFRPLPQLGSKLTLGETDFSSNIFDGFSYTGAALASDERMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 19141 - protein, 430 aa, Escherichia coli O139:H28; identical to SEQ ID NO: 5758
  strain E24377A / ETEC

SEQ ID NO: 19142 - protein, 360 aa, Escherichia coli O139:H28; identical to SEQ ID NO: 6315
  strain E24377A / ETEC

SEQ ID NO: 19143 - protein, 331 aa, Escherichia coli O139:H28; identical to SEQ ID NO: 6456
  strain E24377A / ETEC

SEQ ID NO: 19144 - protein, 760 aa, Escherichia coli O139:H28; identical to SEQ ID NO: 6455
  strain E24377A / ETEC

SEQ ID NO: 19145 - protein, 203 aa, Escherichia coli O139:H28; identical to SEQ ID NO: 6414
  strain E24377A / ETEC

SEQ ID NO: 19146 - protein, 362 aa, Escherichia coli O139:H28; identical to SEQ ID NO: 5809
  strain E24377A / ETEC

SEQ ID NO: 19147 - protein, 233 aa, Escherichia coli O139:H28; identical to SEQ ID NO: 6327
  strain E24377A / ETEC

SEQ ID NO: 19148 - protein, 866 aa, Escherichia coli O139:H28
  strain E24377A / ETEC
MYRTHRQHSLLSSGGVPSFIGGLVVFVSAAFNAQAETWFDPAFFKDDPSMVADLSRFEKGQKITPGVYRVDIVLNQTIVNTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 19149 - protein, 245 aa, Escherichia coli O139:H28
  strain E24377A / ETEC
MPARHLYFIMTNTWNRLALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAIRSVFKLFWRPEGLPGDPLEAYQQLRWTWNSQGVQLTNPTPYYINLIQVSVNGKALSNAGVVPPKSQRQTSWCQAIAPCHVAWRAINDYGGLSAKKEQNLP

SEQ ID NO: 19150 - protein, 511 aa, Escherichia coli O139:H28; identical to SEQ ID NO: 5749
  strain E24377A / ETEC

SEQ ID NO: 19151 - protein, 191 aa, Escherichia coli O139:H28
  strain E24377A / ETEC
MKKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSMKKDGDELDITGDLTLNGVTKPVTLEAKLIGQGDDPWGGKRAGFEAEGKIKLKDFNIKTDLGPASQEVDLIISVEGVQQK

SEQ ID NO: 19152 - protein, 232 aa, Escherichia coli O139:H28; identical to SEQ ID NO: 5747
  strain E24377A / ETEC

SEQ ID NO: 19153 - protein, 365 aa, Escherichia coli O139:H28; identical to SEQ ID NO: 6335
  strain E24377A / ETEC

SEQ ID NO: 19154 - protein, 729 aa, Escherichia coli O139:H28; identical to SEQ ID NO: 5745
  strain E24377A / ETEC

SEQ ID NO: 19155 - protein, 213 aa, Escherichia coli O139:H28; identical to SEQ ID NO: 5744
  strain E24377A / ETEC

SEQ ID NO: 19156 - protein, 565 aa, Escherichia coli O139:H28; identical to SEQ ID NO: 9880
  strain E24377A / ETEC

SEQ ID NO: 19157 - protein, 207 aa, Escherichia coli O139:H28; identical to SEQ ID NO: 5743
  strain E24377A / ETEC

SEQ ID NO: 19158 - protein, 848 aa, Escherichia coli O139:H28
  strain E24377A / ETEC
MRNRMSRFSHDDYTRAMLNLLPSGIAWSRLPDSVQHRLIRGLAQAYRKSDADACALITGAFPETADALTDEWYASLGLNDECGTQASTTDPAQARKFILAKLLSTGGQSVAYFTELAATMGYSISIREYRTPLCGFSWSGHLLSDDNRFNWTVVVAPPGDEVTTSRAYLECLFRRYAPAHTLVTFEWQSSYSAALSIAWDNITHVLSGALTADEGVVVSGVTVNVVIKSASGQRYVATVTTDSEGHWSYEMEDDDFANGWYSSTAYNDLVRLRQLPAGQKSCSYLASNTPSLVSIDSGAFRFCKNATAFDSAFYRCKGLTAIPPGLFAECASATTFYQAFYECTGLTAVGDSAFAGCTGVTTFRQAFYGCTGLRAVGESVFAGCTGATTFEDTFYGCTGLSTVGNSVFAGCASATTFLQAFYGCQALTSLGQGIFADCTGVTTFLQAFYNCRGLTALPEGMFDSCTAVTTFSNAFYGCTALTAIPEGLFDSCTGVTTFNRTFYGCAALTAIPAKLFANCTEVATFEGVFSGCSGLVTIPAGLFEKLTSVTTFDSAFYGCRALTTVGDRVFAGCTGTTTFASVFEGCTGLVTIPADVFAGCSGVRSFYRSFFGCTGLAMVPPELFADCTGATTFYTTFYRCTRLSEVPAELFSGCTGAKSFYKTFGECTGLSEVPARLFADCTGATTFEGVFSGCRGLTTIPAGLFANSASVTTFFQAFYECTGLTAIPSGLFADCVSVTTFRQTFYGCSGLRSMGDGVFAGCASATTFEGTFYGCTGLESDVNDILPAEEYPQITSVYSCFYNCRSLQGSGCALIEKLPGVTSYADAFYNCVSLSDFRTLSERYPVWV

SEQ ID NO: 19159 - protein, 551 aa, Escherichia coli O139:H28; identical to SEQ ID NO: 5742
  strain E24377A / ETEC

SEQ ID NO: 19160 - protein, 700 aa, Escherichia coli O139:H28; identical to SEQ ID NO: 7945
  strain E24377A / ETEC

SEQ ID NO: 19161 - protein, 149 aa, Escherichia coli O139:H28
  strain E24377A / ETEC
MQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDITHAATGDISFQTINDYGALTPRIKATMQ

SEQ ID NO: 19162 - protein, 340 aa, Escherichia coli O139:H28
  strain E24377A / ETEC
MTLHRFKKIALLSALGIAAISMNVQAAERIAFIPKLVGVGFFTSGGNGAQQAGKELSVDVTYDGPTEPSVSGQVQLINNFVNQGYNAIIVSAVSPDGLCPALKRAMQRGVRVLTWDSDTKPECRSYYINQGTPAQLGGMLVDMAARQVNKDKAKVAFFYSSPTVTDQNQWVKEAKAKIAKEHPGWEIVTTQFGYNDATKSLQTAEGILKAYSDLDAIIAPDANALPAAAQAAENLKNDKVAIVGFSTPNVMRPYVERGTVKEFGLWDVVQQGKISVYVADALLKKGSMKTGDKLDIQGVGQVEVSPNSVQGYDYEADGNGIVLLPERVIFNKENIGKYDF

SEQ ID NO: 19163 - protein, 111 aa, Escherichia coli O139:H28; identical to SEQ ID NO: 7885
  strain E24377A / ETEC

SEQ ID NO: 19164 - protein, 118 aa, Escherichia coli O139:H28 [sequence omitted]

SEQ ID NO: 19165 - protein, 334 aa, Escherichia coli O139:H28; identical to SEQ ID NO: 7357
  strain E24377A / ETEC

SEQ ID NO: 19166 - protein, 826 aa, Escherichia coli O139:H28
  strain E24377A / ETEC
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRMFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 19167 - protein, 224 aa, Escherichia coli O139:H28; identical to SEQ ID NO: 6435
  strain E24377A / ETEC

SEQ ID NO: 19168 - protein, 663 aa, Escherichia coli O139:H28; identical to SEQ ID NO: 8669
  strain E24377A / ETEC

SEQ ID NO: 19169 - protein, 828 aa, Escherichia coli O139:H28
  strain E24377A / ETEC
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSDTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKYPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 19170 - protein, 162 aa, Escherichia coli O139:H28; identical to SEQ ID NO: 5896
  strain E24377A / ETEC

SEQ ID NO: 19171 - protein, 363 aa, Escherichia coli O139:H28; identical to SEQ ID NO: 7893
  strain E24377A / ETEC

SEQ ID NO: 19172 - protein, 200 aa, Escherichia coli O139:H28; identical to SEQ ID NO: 6311
  strain E24377A / ETEC

SEQ ID NO: 19173 - protein, 274 aa, Escherichia coli O139:H28; identical to SEQ ID NO: 6549
  strain E24377A / ETEC

SEQ ID NO: 19174 - protein, 241 aa, Escherichia coli O139:H28
  strain E24377A / ETEC
MGATTLALLLSAASLSAQASVTPDRTRLIFNESDKSISVTLRNNDPKLPYLAQSWIEDEKGNKISSPLTVLPPVQRIDSMMNGQVKVQGMPDINKLPADRESLFYFNVREIPPKSNKANTLQIALQTRIKLFWRPKALENVSMKNPWQYKVTLTRNGQEFTVNNPTPYYVIFSNASAEKNGNPAAGFSPLVLLPKTSAPLGVKMDSVPVLTYVNDFDARMPLFFKCTGNTCQVDEEHSRKG

SEQ ID NO: 19175 - protein, 881 aa, Escherichia coli O139:H28
  strain E24377A / ETEC
MPDHSLFRLRILPWCIALAMSGSYSSVWAEDDIQFDSRFLELKGDTKIDLKRFSSQGYVEPGKYNLQIQLNKQPLAEEYDIYWYAGEDDASKSYACLTPELVAQFGLKEDVAKNLQWSHDAKCLKSGQLEGMEIKADLSQSALVISLPQAYLEYTWPDWDPPSRWDDGISGIVADYSINAQTRHEENGGDDSNEISGNGTVGVNLGPWRMRADWQTNYQHTRSNDDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNREDKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLSDGSHPPFGAEVKNDNEQTVGLVDDDGNVYLAGVKPGEHMSVFWSGIAHCDINLPAPLPADLFNGLLLPCQHKGNVVPVVPDGIKPVIQEQTQQVTPTNPPVSVSANQ

SEQ ID NO: 19176 - protein, 518 aa, Escherichia coli O139:H28; identical to SEQ ID NO: 7565
  strain E24377A / ETEC

SEQ ID NO: 19177 - protein, 432 aa, Escherichia coli O139:H28; identical to SEQ ID NO: 5727
  strain E24377A / ETEC

SEQ ID NO: 19178 - protein, 359 aa, Escherichia coli O139:H28; identical to SEQ ID NO: 6332
  strain E24377A / ETEC

SEQ ID NO: 19179 - protein, 686 aa, Escherichia coli O139:H28; identical to SEQ ID NO: 6453
  strain E24377A / ETEC

SEQ ID NO: 19180 - protein, 834 aa, Escherichia coli O139:H28
  strain E24377A / ETEC
MYKKLKLTTISELIKNIYCSLSVLIIGCASAYAVEFNKDLIEAEDRENVNLSQFETDGQLPVGKYSLNALINNKRTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLVSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 19181 - protein, 249 aa, Escherichia coli O139:H28
  strain E24377A / ETEC
MRYLNTKNLIAAGVLLACMSSIAWGAIIPDRTRIIMNESDKGEALKLTNQSKNLPYLAQTWIEDTKGNKSRDFIVTVPPMVRLNPSEQIQIRMISHEKIAQLPNDRETLFYFNVREIPPKTDKKNVMQVTMQHALKLFWRPKAIELEDDGVMSYEKVEIIRRNDGSIRFNNKMPYHVTLGYIGTNGITMLPQTQSLMVTPYSHADTQFKNVPSAFQVGYINDFGGLSFYEINCPTVNNSCNVSVAKRDK

SEQ ID NO: 19182 - protein, 231 aa, Escherichia coli O139:H28; identical to SEQ ID NO: 6351
  strain E24377A / ETEC

SEQ ID NO: 19183 - protein, 838 aa, Escherichia coli O139:H28; identical to SEQ ID NO: 7363
  strain E24377A / ETEC

SEQ ID NO: 19184 - protein, 678 aa, Escherichia coli O139:H28; identical to SEQ ID NO: 6353
  strain E24377A / ETEC

SEQ ID NO: 19185 - protein, 412 aa, Escherichia coli O139:H28; identical to SEQ ID NO: 6390
  strain E24377A / ETEC

SEQ ID NO: 19186 - protein, 538 aa, Escherichia coli O139:H28
  strain E24377A / ETEC
MFRRNLITSAILLMAPLAFSAQSLAESLTVEQRLELLEKALRETQSELKKYKDEEKKKYTPATVNRSVSTNDQGYAANPFPTSSAAKPDAVLVKNEEKNASETGSIYSSMTLKDFSKFVKDEIGFSYNGYYRSGWGTASHGSPKSWAIGSLGRFGNEYSGWFDLQLKQRVYNENGKRVDAVVMMDGNVGQQYSTGWFGDNAGGENFMQFSDMYVTTKGFLPFAPEADFWVGKHGAPKIEIQILDWKTQRTDAAAGVGLENWKVGPGKIDIALVREDVDDYDRSLQNKQQINTNTIDLRYKDIPLWDKATLMVSGRYVTANESASEKDNQDNNGYYDWKDTWMFGTSLTQKFDKGGFNEFSFLVANNSIASNFGRYAGASPFTTFNGRYYGDHTGGTAVRLTSQGEAYIGDHFIVANAIVYSFGNDIYSYETGAHSDFESIRAVVRPAYIWDQYNQTGVELGYFTQQNKDANSNKFNESGYKTTLFHTFKVNTSMLTSRPEIRFYATYIKALENELDGFTFGDNKDDQFAVGAQAEIWW

SEQ ID NO: 19187 - protein, 243 aa, Escherichia coli O139:H28; identical to SEQ ID NO: 6145
  strain E24377A / ETEC

SEQ ID NO: 19188 - protein, 208 aa, Escherichia coli O139:H28; identical to SEQ ID NO: 5717
  strain E24377A / ETEC

SEQ ID NO: 19189 - protein, 614 aa, Escherichia coli O139:H28
  strain E24377A / ETEC
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHFGRYDSSATLDEMKQYTVQWANNVIVGHGSIGAGVDWQKQTTTPGTGYVENGYDQRNTGIYLTGLQQVGDFTFEGAARNDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 19190 - protein, 446 aa, Escherichia coli O139:H28; identical to SEQ ID NO: 6459
  strain E24377A / ETEC

SEQ ID NO: 19191 - protein, 237 aa, Escherichia coli O139:H28
  strain E24377A / ETEC
MRKITQAISAVCLLFALNSSAVALASSPSPINPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPVTNMNPVIFAGDKPGQNTKSQWLQDKNIRIFYGDSDNDITAARDVGARGIRILRASNSTYKPLPQAGAFGEEVIVNSEY

SEQ ID NO: 19192 - protein, 478 aa, Escherichia coli O139:H28; identical to SEQ ID NO: 5711
  strain E24377A / ETEC

SEQ ID NO: 19193 - protein, 774 aa, Escherichia coli O139:H28
  strain E24377A / ETEC
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEGHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 19194 - protein, 368 aa, Escherichia coli O139:H28
  strain E24377A / ETEC
MNKTITALAIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAVDKINAYYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNDSLIFAGGAGFKGSRENYQNGKNYAHEGLKKSYSTDIHLWHNGKWDKSGELSQGRAYGVSLPWNNSLLIIGGETAGGKAVTDSVFISVKDNKVTVQN

SEQ ID NO: 19195 - protein, 784 aa, Escherichia coli O150:H5; identical to SEQ ID NO: 8272
  strain SE15

SEQ ID NO: 19196 - protein, 654 aa, Escherichia coli O150:H5; identical to SEQ ID NO: 8265
  strain SE15

SEQ ID NO: 19197 - protein, 900 aa, Escherichia coli O150:H5; identical to SEQ ID NO: 17657
  strain SE15

SEQ ID NO: 19198 - protein, 412 aa, Escherichia coli O150:H5; identical to SEQ ID NO: 11006
  strain SE15

SEQ ID NO: 19199 - protein, 170 aa, Escherichia coli O150:H5
  strain SE15
MSGILTRWRQFGKRYFWPHLLLGMVAASLGLPALSNAAEPNAPAKATTRNHEPSAKVNFGQLALLETNTRRPNSNYSVDYWHQHAIRTVIRHLSFAMAPQTLPVAEESLPLQAQHLALLDTLSALLTQEGTPSEKGYRIDYAHFTPQAKFSTPVWISQAQGIRAGPQRLS

SEQ ID NO: 19200 - protein, 866 aa, Escherichia coli O150:H5
  strain SE15
MTIKPTKNYHNHLTRIATFCALLYCNGAFCAELVEYDHTFLMGQNASNIDLSRYSEGNPAIPGVYDVSVYVNDQPVINQSITFVAIEGKKNAQACITLKNLLQFHINSPDINSEKAVLLARDEALGNCLNLTEIIPQASVRYDVNDQRLDIDVPQAWVMKNYQNYVDPSLWENGINAAMLSYNLNGYHSETPGRKNDSIYAAFNGGMNLGAWRLRASGNYNWMTDSGGNYDFKNRYIQRDIASLRSQFIIGESYTTGETFDSVSIRGIRLYSDSRMLPPTLASFAPIIHGVANTNAKVTITQGGYKIYETTVPPGAFVIDDLSPSGYGSDLIVTIEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSISAQRSWNEDGDADDSVYLSFTIPIEKLLGTEQRTSGFQSIDTQMSSDFKGNNQLNVSSSGYNDNARVSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDDQGNVIGNVGQGGQAFVRGIEQQGNINIKWLEESKPVSCLAHYQQSSEAEKIAQSIILNGIRCQIQ

SEQ ID NO: 19201 - protein, 246 aa, Escherichia coli O150:H5; identical to SEQ ID NO: 17682
  strain SE15

SEQ ID NO: 19202 - protein, 249 aa, Escherichia coli O150:H5
  strain SE15
MKGLFDHGGLFMSVFSRVCLGFTFLLTALQVQASIVLGGTRIIYPSNQNEVQITLKNKDAYARYLVQSWVSNIDGSKAPFLITPPVYKLEENRQTLLHIVFTGDKNKLPQDRESLFLANIKSVSAMPEELKDKNTLQFAMKARLKLFWRPASLDNSDALTAWEKLKFHKEAGKLIVKNPTPFYISFSDLTVSGKNIVPTESKSEPGALLMMVGPFSEQRFSLPVGAGSIVEWSVITDYGSSSGKRQQKL

SEQ ID NO: 19203 - protein, 749 aa, Escherichia coli O150:H5; identical to SEQ ID NO: 17683
  strain SE15

SEQ ID NO: 19204 - protein, 266 aa, Escherichia coli O150:H5; identical to SEQ ID NO: 5772
  strain SE15

SEQ ID NO: 19205 - protein, 161 aa, Escherichia coli O150:H5; identical to SEQ ID NO: 5769
  strain SE15

SEQ ID NO: 19206 - protein, 660 aa, Escherichia coli O150:H5; identical to SEQ ID NO: 6837
  strain SE15

SEQ ID NO: 19207 - protein, 351 aa, Escherichia coli O150:H5; identical to SEQ ID NO: 8304
  strain SE15

SEQ ID NO: 19208 - protein, 208 aa, Escherichia coli O150:H5; identical to SEQ ID NO: 5717
  strain SE15

SEQ ID NO: 19209 - protein, 746 aa, Escherichia coli O150:H5; identical to SEQ ID NO: 8287
  strain SE15

SEQ ID NO: 19210 - protein, 614 aa, Escherichia coli O150:H5; identical to SEQ ID NO: 17686
  strain SE15

SEQ ID NO: 19211 - protein, 446 aa, Escherichia coli O150:H5; identical to SEQ ID NO: 5873
  strain SE15

SEQ ID NO: 19212 - protein, 237 aa, Escherichia coli O150:H5; identical to SEQ ID NO: 7546
  strain SE15

SEQ ID NO: 19213 - protein, 478 aa, Escherichia coli O150:H5; identical to SEQ ID NO: 6796
  strain SE15

SEQ ID NO: 19214 - protein, 193 aa, Escherichia coli O150:H5; identical to SEQ ID NO: 6300
  strain SE15

SEQ ID NO: 19215 - protein, 430 aa, Escherichia coli O150:H5; identical to SEQ ID NO: 5758
  strain SE15

SEQ ID NO: 19216 - protein, 332 aa, Escherichia coli O150:H5; identical to SEQ ID NO: 5757
  strain SE15

SEQ ID NO: 19217 - protein, 760 aa, Escherichia coli O150:H5; identical to SEQ ID NO: 17654
  strain SE15

SEQ ID NO: 19218 - protein, 234 aa, Escherichia coli O150:H5; identical to SEQ ID NO: 15685
  strain SE15

SEQ ID NO: 19219 - protein, 204 aa, Escherichia coli O150:H5; identical to SEQ ID NO: 5755
  strain SE15

SEQ ID NO: 19220 - protein, 362 aa, Escherichia coli O150:H5; identical to SEQ ID NO: 5808
  strain SE15

SEQ ID NO: 19221 - protein, 511 aa, Escherichia coli O150:H5; identical to SEQ ID NO: 5749
  strain SE15

SEQ ID NO: 19222 - protein, 191 aa, Escherichia coli O150:H5; identical to SEQ ID NO: 16539
  strain SE15

SEQ ID NO: 19223 - protein, 368 aa, Escherichia coli O150:H5; identical to SEQ ID NO: 8785
  strain SE15

SEQ ID NO: 19224 - protein, 241 aa, Escherichia coli O150:H5; identical to SEQ ID NO: 6143
  strain SE15

SEQ ID NO: 19225 - protein, 878 aa, Escherichia coli O150:H5
  strain SE15
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASISGMNLLADDACVPLTAMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGIYGTLLEDNDLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 19226 - protein, 232 aa, Escherichia coli O150:H5; identical to SEQ ID NO: 8305
  strain SE15

SEQ ID NO: 19227 - protein, 366 aa, Escherichia coli O150:H5; identical to SEQ ID NO: 7513
  strain SE15

SEQ ID NO: 19228 - protein, 729 aa, Escherichia coli O150:H5
  strain SE15
MLSTQFNRDNQHQAIIKPSLLAGCIALALLPSAAFAAPATEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDRSPQSLAQDDTTHMKSLYAATRVTLADPLHLILGARYTKWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNLSITGMYQF

SEQ ID NO: 19229 - protein, 214 aa, Escherichia coli O150:H5
  strain SE15
MMTKMSRYALITALAMFLAGCVGQREPAPVEEVKPAPEQPTEPQQPVPTVPSVPTIPQQPGPIEHEDQTAPPAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 19230 - protein, 360 aa, Escherichia coli O150:H5
  strain SE15
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEVNGDGFGFSTTYEYEGFGVGATYAKSDRTDGQVAYGKSKFNASGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 19231 - protein, 656 aa, Escherichia coli O150:H5; identical to SEQ ID NO: 8311
  strain SE15

SEQ ID NO: 19232 - protein, 565 aa, Escherichia coli O150:H5; identical to SEQ ID NO: 17679
  strain SE15

SEQ ID NO: 19233 - protein, 207 aa, Escherichia coli O150:H5; identical to SEQ ID NO: 17680
  strain SE15

SEQ ID NO: 19234 - protein, 551 aa, Escherichia coli O150:H5; identical to SEQ ID NO: 5885
  strain SE15

SEQ ID NO: 19235 - protein, 700 aa, Escherichia coli O150:H5
  strain SE15
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGDVMNVTTQTGQQPPTIEASSYYGSFGSWRYGLKATGATGDGTQPGDVDYTVATTRFTTHGYRDHSGAQKNLANAKLGVRIDDASKLSLIFNSVDIKADDPGGLTEAEWKANPQQAPRAEQYDMRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYIPEDGWYAGTEARYMGDIMADDENTAKAPSYTLVGLFTGYKYNYHNLTVDLFGRVDNLFDKEYVGSVIVNESNGRYYEPAPGRNYGVGINIAWRFE

SEQ ID NO: 19236 - protein, 883 aa, Escherichia coli O150:H5
  strain SE15
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGHYGTTFFSASRQSYWNTSRSDQQISFGLNVPLGDITTSLNYSYSNNIWQNDRDHLLAFTLNVPFSHWMRTDSQSAFRNSNASYSMSNDLKGGMTNLSGVYGTLLPDNNLNYSVQVGNTQGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPAVSPGTLLNQQTAICR

SEQ ID NO: 19237 - protein, 236 aa, Escherichia coli O150:H5; identical to SEQ ID NO: 8296
  strain SE15

SEQ ID NO: 19238 - protein, 102 aa, Escherichia coli O150:H5; identical to SEQ ID NO: 14041
  strain SE15

SEQ ID NO: 19239 - protein, 118 aa, Escherichia coli O150:H5 [sequence omitted]

SEQ ID NO: 19240 - protein, 334 aa, Escherichia coli O150:H5
  strain SE15
MKKNQFFKESDVTAESVFFMKRRQVLKALGISAAAFSLPHAAHADLLSWFKGNDRPPAPAGKPLEFSKPAAWQNNLPLTPADKVSGYNNFYEFGLDKADPAANAGSLKTEPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILDVQRQPTLLFNGYADQVASLYRGLDLRENF

SEQ ID NO: 19241 - protein, 673 aa, Escherichia coli O150:H5; identical to SEQ ID NO: 6170
  strain SE15

SEQ ID NO: 19242 - protein, 715 aa, Escherichia coli O150:H5; identical to SEQ ID NO: 6806
  strain SE15

SEQ ID NO: 19243 - protein, 721 aa, Escherichia coli O150:H5; identical to SEQ ID NO: 6807
  strain SE15

SEQ ID NO: 19244 - protein, 826 aa, Escherichia coli O150:H5
  strain SE15
MLRMTPLASAIVALLIGIEAYAAEETFDTHFMIGGMKDQQVANIRLDDNQPLPGQYDIDIYVNKQWRGKYEIIVKDNPQETCLSREMIKRLGINTDNFASGKQCLTFKQLIQGGSYTWDIGVFRLDFSVPQAWVEELEIGYVPPENWERGINAFYTSYYMSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRFGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICQ

SEQ ID NO: 19245 - protein, 224 aa, Escherichia coli O150:H5
  strain SE15
MKGLLALLISSMVLPAHAGIVIYGTRIIYPAEHKEVMVQLMNQGNRSSLMQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWHLTIIDDHGNYISDKI

SEQ ID NO: 19246 - protein, 679 aa, Escherichia coli O150:H5
  strain SE15
MSDTHFIFVVTSWRYGMFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 19247 - protein, 828 aa, Escherichia coli O150:H5; identical to SEQ ID NO: 6558
  strain SE15

SEQ ID NO: 19248 - protein, 162 aa, Escherichia coli O150:H5; identical to SEQ ID NO: 5896
  strain SE15

SEQ ID NO: 19249 - protein, 373 aa, Escherichia coli O150:H5; identical to SEQ ID NO: 5781
  strain SE15

SEQ ID NO: 19250 - protein, 200 aa, Escherichia coli O150:H5; identical to SEQ ID NO: 5898
  strain SE15

SEQ ID NO: 19251 - protein, 274 aa, Escherichia coli O150:H5
  strain SE15
MNKTAIALLALLASSASLAATPWQKITQPVPGNAQSIGSFSNGCIIGADTLPIQSEHYQVMRTDQRRYFGHPDLVMFIQRLSRQVSNLGMGTVLIGDMGMPAGGRFNGGHASHQTGLDVDIFLQLPKTRWTSAQLLRPQALDLVSRDGKHVVPTLWKPEIFSLIKLAAQDKDVTRIFVNPAIKQQLCLDAGTDRDWLRKVRPWFQHRAHMHVRLRCPADSLECEDQPLPPPGDGCGAELQSWFEPPKPGTTKPEKKTPPPLPPSCQALLDEHVI

SEQ ID NO: 19252 - protein, 250 aa, Escherichia coli O150:H5; identical to SEQ ID NO: 8299
  strain SE15

SEQ ID NO: 19253 - protein, 882 aa, Escherichia coli O150:H5
  strain SE15
MPNHSNFRLRGIACYIALAISGGSVNAWADDSIQFDPRFLELKGDTKIDLGKFSKKGYVDAGKYNLRVFINKQSLSDEYDINWYVSENDPTKTYACLTPELVAALGLKEGIAKSLQWTHNDECLKPGQLDGMEVENDLSQSALLLTVPQAYLEYTSSDWDPPSRWDDGISGLIADYSLNAQTRHQEQGGEDSHDISGNGTVGANLGAWRFRADWQSDYQHTRSNDDEDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADEHYQSAAMGVGRDLAQFGALAFDVTHSHVNLDHDSAYGKGKLDGNSFRVSYAKDFDELNSRVTFAGYRFSEKNFMTMSEYLDASQSDMARTGNDKEMYTITYNQNFAAAGVSVYLNYSHRTYWDRPEQTNYNLMFSHYFNMGSIRNMSISVTGYRYEYDDNTDKGMYLSMSIPWSDSSTVTYNGSYGSGSDSSQVGYFNRIDDATHYQINVGTSEQHGSVDGYLSHDGTLAKVDLSANYHEGEYRSAGIALQGGATLTAHGGALHRTQNMGGTRLLIDADGIANVPVESNGALVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGINAGEHMMVFWEGSAQCEIVLPKPLPADLFRGLLLPCEQKGTTAPDSLAPEIKPVIQDQTRQVTPSEAPTSISATQ

SEQ ID NO: 19254 - protein, 518 aa, Escherichia coli O150:H5; identical to SEQ ID NO: 7565
  strain SE15

SEQ ID NO: 19255 - protein, 505 aa, Escherichia coli O150:H5; identical to SEQ ID NO: 8268
  strain SE15

SEQ ID NO: 19256 - protein, 432 aa, Escherichia coli O150:H5; identical to SEQ ID NO: 5727
  strain SE15

SEQ ID NO: 19257 - protein, 359 aa, Escherichia coli O150:H5; identical to SEQ ID NO: 5847
  strain SE15

SEQ ID NO: 19258 - protein, 659 aa, Escherichia coli O150:H5
  strain SE15
MLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 19259 - protein, 713 aa, Escherichia coli O150:H5; identical to SEQ ID NO: 17773
  strain SE15

SEQ ID NO: 19260 - protein, 222 aa, Escherichia coli O150:H5; identical to SEQ ID NO: 5850
  strain SE15

SEQ ID NO: 19261 - protein, 840 aa, Escherichia coli O150:H5; identical to SEQ ID NO: 17702
  strain SE15

SEQ ID NO: 19262 - protein, 249 aa, Escherichia coli O150:H5
  strain SE15
MNIMKSPLITTGMICLLGICNFAQATVSPDRTRIIFNASNKSATVRLTNQSKIDPYLAQSWIEDASGKKTRGYISTLPPMERIEPDEQVQIRLMALASLNNLPQDRETLFYYNVREIPPRTKEQNVMQIAMQSRLKLFWRPKAIELKEGQMVPLQKVTITRTAAGLTLNNPTPYHITVGYIGTNGKTLMPGADSIMVTPFASATQYLNNLPSTFQLGFVADYGGLEMFKVECNSVQSLCQSSPAKKGKI

SEQ ID NO: 19263 - protein, 678 aa, Escherichia coli O150:H5
  strain SE15
MVPSTFSRLKAARCLPVVLAALIFAGCGTHTPDQSTAYMQGTAQADSAFYLQQMQQSSDDTRINWQLLAIRALVKEGKTGQAVELVNQLPQELNDNQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVNAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTASPDCVINRKLSWLQYQQGQVVPAS

SEQ ID NO: 19264 - protein, 119 aa, Escherichia coli O150:H5; identical to SEQ ID NO: 5803
  strain SE15

SEQ ID NO: 19265 - protein, 753 aa, Escherichia coli O150:H5; identical to SEQ ID NO: 5801
  strain SE15

SEQ ID NO: 19266 - protein, 656 aa, Escherichia coli O150:H5; identical to SEQ ID NO: 7573
  strain SE15

SEQ ID NO: 19267 - protein, 89 aa, Escherichia coli O157:H-; identical to SEQ ID NO: 6053

SEQ ID NO: 19268 - protein, 89 aa, Escherichia coli O157:H-; identical to SEQ ID NO: 6233

SEQ ID NO: 19269 - protein, 89 aa, Escherichia coli O157:H-; identical to SEQ ID NO: 6177

SEQ ID NO: 19270 - protein, 816 aa, Escherichia coli O157:H- str. 493-89; identical to SEQ ID NO: 11428

SEQ ID NO: 19271 - protein, 227 aa, Escherichia coli O157:H- str. 493-89; identical to SEQ ID NO: 11429

SEQ ID NO: 19272 - protein, 784 aa, Escherichia coli O157:H- str. 493-89
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVSIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 19273 - protein, 170 aa, Escherichia coli O157:H- str. 493-89; identical to SEQ ID NO: 5855

SEQ ID NO: 19274 - protein, 241 aa, Escherichia coli O157:H- str. 493-89; identical to SEQ ID NO: 11431

SEQ ID NO: 19275 - protein, 111 aa, Escherichia coli O157:H- str. 493-89; identical to SEQ ID NO: 5738

SEQ ID NO: 19276 - protein, 118 aa, Escherichia coli O157:H- str. 493-89 [sequence omitted]

SEQ ID NO: 19277 - protein, 397 aa, Escherichia coli O157:H- str. 493-89; identical to SEQ ID NO: 11784

SEQ ID NO: 19278 - protein, 715 aa, Escherichia coli O157:H- str. 493-89; identical to SEQ ID NO: 11710

SEQ ID NO: 19279 - protein, 75 aa, Escherichia coli O157:H- str. 493-89
GDMYTSADIFDSVRFTGVRLFRDMQMLPNSKQNFTPRVQGIAQSNALVTIEQNGFVVYQKEVPPGPFSISDLQLA

SEQ ID NO: 19280 - protein, 659 aa, Escherichia coli O157:H- str. 493-89; identical to SEQ ID NO: 5736

SEQ ID NO: 19281 - protein, 162 aa, Escherichia coli O157:H- str. 493-89; identical to SEQ ID NO: 5734

SEQ ID NO: 19282 - protein, 367 aa, Escherichia coli O157:H- str. 493-89; identical to SEQ ID NO: 5700

SEQ ID NO: 19283 - protein, 828 aa, Escherichia coli O157:H- str. 493-89; identical to SEQ ID NO: 5735

SEQ ID NO: 19284 - protein, 200 aa, Escherichia coli O157:H- str. 493-89; identical to SEQ ID NO: 5732

SEQ ID NO: 19285 - protein, 274 aa, Escherichia coli O157:H- str. 493-89; identical to SEQ ID NO: 5730

SEQ ID NO: 19286 - protein, 252 aa, Escherichia coli O157:H- str. 493-89; identical to SEQ ID NO: 11406

SEQ ID NO: 19287 - protein, 879 aa, Escherichia coli O157:H- str. 493-89
MPDHSLFRLRVLPCCVALAMSGSYVNAWAENEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDITHSHTRLDKETAYGKGSLDGNSFRLSYSKDFDELNSRVTFAGYRFSEENFMTMSEYLDASDSEMVRTGNDKEMYTATYNQNFRDAGVSVYLNYTRHTYWDRDEQTNYNVMLSHYFNLGSIRNMSISMTGYRYEYDNQADKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQATLTEGAIGYRKFSVISGQKAMAVLRLQDGSYPPFGAEVKNDSAQNVGLVDDDGNVYLAGVKPGEHMIVSWGGVAHCDIHLPDPLPADLFNGLLLPCQQTGAISPSMPHEIKPVIQEQTQQVMPTEAPVSVSAN

SEQ ID NO: 19288 - protein, 518 aa, Escherichia coli O157:H- str. 493-89; identical to SEQ ID NO: 11400

SEQ ID NO: 19289 - protein, 271 aa, Escherichia coli O157:H- str. 493-89
DPEVLKQAVNDAVANIPVPADGKSITPDDVRPMLEQMVKEAVSHIPVPRDGRDYDPEVLQKAVNDAVANIPQPADGKSLTPDDVRPMLEQMVKEAVSHIPVPRDGRDYDPDVLQKAVLDAVRALPAPQDGRDATALEIIPAIDDQKSFPRGTYATHQGGLWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRDAGGGK

SEQ ID NO: 19290 - protein, 432 aa, Escherichia coli O157:H- str. 493-89; identical to SEQ ID NO: 5727

SEQ ID NO: 19291 - protein, 567 aa, Escherichia coli O157:H- str. 493-89; identical to SEQ ID NO: 11409

SEQ ID NO: 19292 - protein, 359 aa, Escherichia coli O157:H- str. 493-89; identical to SEQ ID NO: 11410

SEQ ID NO: 19293 - protein, 713 aa, Escherichia coli O157:H- str. 493-89; identical to SEQ ID NO: 11726

SEQ ID NO: 19294 - protein, 231 aa, Escherichia coli O157:H- str. 493-89; identical to SEQ ID NO: 5724

SEQ ID NO: 19295 - protein, 838 aa, Escherichia coli O157:H- str. 493-89; identical to SEQ ID NO: 5723

SEQ ID NO: 19296 - protein, 678 aa, Escherichia coli O157:H- str. 493-89; identical to SEQ ID NO: 5721

SEQ ID NO: 19297 - protein, 660 aa, Escherichia coli O157:H- str. 493-89; identical to SEQ ID NO: 11731

SEQ ID NO: 19298 - protein, 412 aa, Escherichia coli O157:H- str. 493-89; identical to SEQ ID NO: 5718

SEQ ID NO: 19299 - protein, 228 aa, Escherichia coli O157:H- str. 493-89; identical to SEQ ID NO: 11499

SEQ ID NO: 19300 - protein, 512 aa, Escherichia coli O157:H- str. 493-89; identical to SEQ ID NO: 5948

SEQ ID NO: 19301 - protein, 108 aa, Escherichia coli O157:H- str. 493-89; identical to SEQ ID NO: 11583

SEQ ID NO: 19302 - protein, 747 aa, Escherichia coli O157:H- str. 493-89; identical to SEQ ID NO: 5773

SEQ ID NO: 19303 - protein, 266 aa, Escherichia coli O157:H- str. 493-89; identical to SEQ ID NO: 5770

SEQ ID NO: 19304 - protein, 161 aa, Escherichia coli O157:H- str. 493-89; identical to SEQ ID NO: 5769

SEQ ID NO: 19305 - protein, 208 aa, Escherichia coli O157:H- str. 493-89; identical to SEQ ID NO: 5717

SEQ ID NO: 19306 - protein, 614 aa, Escherichia coli O157:H- str. 493-89; identical to SEQ ID NO: 5716

SEQ ID NO: 19307 - protein, 368 aa, Escherichia coli O157:H- str. 493-89; identical to SEQ ID NO: 11425

SEQ ID NO: 19308 - protein, 241 aa, Escherichia coli O157:H- str. 493-89; identical to SEQ ID NO: 5709

SEQ ID NO: 19309 - protein, 878 aa, Escherichia coli O157:H- str. 493-89; identical to SEQ ID NO: 5706

SEQ ID NO: 19310 - protein, 445 aa, Escherichia coli O157:H- str. 493-89; identical to SEQ ID NO: 12556

SEQ ID NO: 19311 - protein, 237 aa, Escherichia coli O157:H- str. 493-89; identical to SEQ ID NO: 5713

SEQ ID NO: 19312 - protein, 478 aa, Escherichia coli O157:H- str. 493-89; identical to SEQ ID NO: 5711

SEQ ID NO: 19313 - protein, 230 aa, Escherichia coli O157:H- str. 493-89; identical to SEQ ID NO: 5765

SEQ ID NO: 19314 - protein, 869 aa, Escherichia coli O157:H- str. 493-89; identical to SEQ ID NO: 5762

SEQ ID NO: 19315 - protein, 193 aa, Escherichia coli O157:H- str. 493-89; identical to SEQ ID NO: 5760

SEQ ID NO: 19316 - protein, 746 aa, Escherichia coli O157:H- str. 493-89; identical to SEQ ID NO: 5761

SEQ ID NO: 19317 - protein, 243 aa, Escherichia coli O157:H- str. 493-89; identical to SEQ ID NO: 8524

SEQ ID NO: 19318 - protein, 819 aa, Escherichia coli O157:H- str. 493-89
MDAVNIYRLSVLSCLAMVTPPALTAEFNLNVLDKSIRDSVDISLLNQKGVVAPGDYFVSVTVNNNKISNGQQIRWQKSGDKIIPCINESLIELFGLKSDFRKKLPAIKECVDFSVFPEIIFTFDQANQQLNITIPQAWLAWHSENWTPPSTWNNGIPGFLMDYNLFASTYRPQSGSSSNNLNAYGTTGLNAGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLAAGRPRSSMSHHTEDETFISHEVSWGMLSNTSPYGGMLLAGDDYRSGALGIGQNMLWMGALSFDVTWADSHFDTQQDEQGYSYRFNYSKQVDATNSTISLAAYRFSDRHFHSYANYIDHKYNDADAQDEKQTISLSFGQPITLLNLNLYANILHQSWWNADTSTTANITVGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGAAFHRRSSTNEPRLMVSTDGVGDIPIQGNIDYTNRFGIAVVPFVSSYQPTTVAVNMNDLPDGVTVSENVVKETWTEGAIGFKSLASRAGKDLNVIISDANGHFPPLGADVRQAEGGVSVGMVGENGHAWLSGVDENQQFTVHWGDQKTCAIHLPEHLEDVTKRLILPCH

SEQ ID NO: 19319 - protein, 430 aa, Escherichia coli O157:H- str. 493-89; identical to SEQ ID NO: 5758

SEQ ID NO: 19320 - protein, 351 aa, Escherichia coli O157:H- str. 493-89; identical to SEQ ID NO: 5767

SEQ ID NO: 19321 - protein, 331 aa, Escherichia coli O157:H- str. 493-89; identical to SEQ ID NO: 6551

SEQ ID NO: 19322 - protein, 760 aa, Escherichia coli O157:H- str. 493-89; identical to SEQ ID NO: 5756

SEQ ID NO: 19323 - protein, 203 aa, Escherichia coli O157:H- str. 493-89; identical to SEQ ID NO: 6414

SEQ ID NO: 19324 - protein, 362 aa, Escherichia coli O157:H- str. 493-89; identical to SEQ ID NO: 5754

SEQ ID NO: 19325 - protein, 233 aa, Escherichia coli O157:H- str. 493-89; identical to SEQ ID NO: 5752

SEQ ID NO: 19326 - protein, 229 aa, Escherichia coli O157:H- str. 493-89; identical to SEQ ID NO: 11765

SEQ ID NO: 19327 - protein, 229 aa, Escherichia coli O157:H- str. 493-89; identical to SEQ ID NO: 11455

SEQ ID NO: 19328 - protein, 840 aa, Escherichia coli O157:H- str. 493-89; identical to SEQ ID NO: 11767

SEQ ID NO: 19329 - protein, 233 aa, Escherichia coli O157:H- str. 493-89; identical to SEQ ID NO: 11381

SEQ ID NO: 19330 - protein, 517 aa, Escherichia coli O157:H- str. 493-89; identical to SEQ ID NO: 6817

SEQ ID NO: 19331 - protein, 191 aa, Escherichia coli O157:H- str. 493-89; identical to SEQ ID NO: 5748

SEQ ID NO: 19332 - protein, 232 aa, Escherichia coli O157:H- str. 493-89; identical to SEQ ID NO: 5746

SEQ ID NO: 19333 - protein, 729 aa, Escherichia coli O157:H- str. 493-89; identical to SEQ ID NO: 5745

SEQ ID NO: 19334 - protein, 213 aa, Escherichia coli O157:H- str. 493-89; identical to SEQ ID NO: 5744

SEQ ID NO: 19335 - protein, 203 aa, Escherichia coli O157:H- str. 493-89; identical to SEQ ID NO: 6347

SEQ ID NO: 19336 - protein, 656 aa, Escherichia coli O157:H- str. 493-89; identical to SEQ ID NO: 11774

SEQ ID NO: 19337 - protein, 207 aa, Escherichia coli O157:H- str. 493-89; identical to SEQ ID NO: 5743

SEQ ID NO: 19338 - protein, 539 aa, Escherichia coli O157:H- str. 493-89; identical to SEQ ID NO: 6525

SEQ ID NO: 19339 - protein, 700 aa, Escherichia coli O157:H- str. 493-89; identical to SEQ ID NO: 5740

SEQ ID NO: 19340 - protein, 366 aa, Escherichia coli O157:H- str. 493-89; identical to SEQ ID NO: 11362

SEQ ID NO: 19341 - protein, 883 aa, Escherichia coli O157:H- str. 493-89; identical to SEQ ID NO: 5702

SEQ ID NO: 19342 - protein, 236 aa, Escherichia coli O157:H- str. 493-89; identical to SEQ ID NO: 11364

SEQ ID NO: 19343 - protein, 816 aa, Escherichia coli O157:H- str. H 2687; identical to SEQ ID NO: 11428

SEQ ID NO: 19344 - protein, 227 aa, Escherichia coli O157:H- str. H 2687; identical to SEQ ID NO: 11429

SEQ ID NO: 19345 - protein, 784 aa, Escherichia coli O157:H- str. H 2687; identical to SEQ ID NO: 19272

SEQ ID NO: 19346 - protein, 170 aa, Escherichia coli O157:H- str. H 2687; identical to SEQ ID NO: 5855

SEQ ID NO: 19347 - protein, 241 aa, Escherichia coli O157:H- str. H 2687; identical to SEQ ID NO: 11431

SEQ ID NO: 19348 - protein, 747 aa, Escherichia coli O157:H- str. H 2687; identical to SEQ ID NO: 5773

SEQ ID NO: 19349 - protein, 266 aa, Escherichia coli O157:H- str. H 2687; identical to SEQ ID NO: 5770

SEQ ID NO: 19350 - protein, 161 aa, Escherichia coli O157:H- str. H 2687; identical to SEQ ID NO: 5769

SEQ ID NO: 19351 - protein, 111 aa, Escherichia coli O157:H- str. H 2687; identical to SEQ ID NO: 5738

SEQ ID NO: 19352 - protein, 118 aa, Escherichia coli O157:H- str. H 2687 [sequence omitted]

SEQ ID NO: 19353 - protein, 397 aa, Escherichia coli O157:H- str. H 2687; identical to SEQ ID NO: 11784

SEQ ID NO: 19354 - protein, 715 aa, Escherichia coli O157:H- str. H 2687; identical to SEQ ID NO: 11710

SEQ ID NO: 19355 - protein, 75 aa, Escherichia coli O157:H- str. H 2687; identical to SEQ ID NO: 19279

SEQ ID NO: 19356 - protein, 659 aa, Escherichia coli O157:H- str. H 2687; identical to SEQ ID NO: 5736

SEQ ID NO: 19357 - protein, 828 aa, Escherichia coli O157:H- str. H 2687; identical to SEQ ID NO: 5735

SEQ ID NO: 19358 - protein, 162 aa, Escherichia coli O157:H- str. H 2687; identical to SEQ ID NO: 5734

SEQ ID NO: 19359 - protein, 367 aa, Escherichia coli O157:H- str. H 2687; identical to SEQ ID NO: 5700

SEQ ID NO: 19360 - protein, 200 aa, Escherichia coli O157:H- str. H 2687; identical to SEQ ID NO: 5732

SEQ ID NO: 19361 - protein, 274 aa, Escherichia coli O157:H- str. H 2687; identical to SEQ ID NO: 5730

SEQ ID NO: 19362 - protein, 252 aa, Escherichia coli O157:H- str. H 2687; identical to SEQ ID NO: 11406

SEQ ID NO: 19363 - protein, 879 aa, Escherichia coli O157:H- str. H 2687; identical to SEQ ID NO: 19287

SEQ ID NO: 19364 - protein, 518 aa, Escherichia coli O157:H- str. H 2687; identical to SEQ ID NO: 11400

SEQ ID NO: 19365 - protein, 185 aa, Escherichia coli O157:H- str. H 2687
MLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRDAGGGK

SEQ ID NO: 19366 - protein, 432 aa, Escherichia coli O157:H- str. H 2687; identical to SEQ ID NO: 5727

SEQ ID NO: 19367 - protein, 567 aa, Escherichia coli O157:H- str. H 2687; identical to SEQ ID NO: 11409

SEQ ID NO: 19368 - protein, 359 aa, Escherichia coli O157:H- str. H 2687; identical to SEQ ID NO: 11410

SEQ ID NO: 19369 - protein, 231 aa, Escherichia coli O157:H- str. H 2687; identical to SEQ ID NO: 5724

SEQ ID NO: 19370 - protein, 838 aa, Escherichia coli O157:H- str. H 2687; identical to SEQ ID NO: 5723

SEQ ID NO: 19371 - protein, 678 aa, Escherichia coli O157:H- str. H 2687; identical to SEQ ID NO: 5721

SEQ ID NO: 19372 - protein, 713 aa, Escherichia coli O157:H- str. H 2687; identical to SEQ ID NO: 11726

SEQ ID NO: 19373 - protein, 412 aa, Escherichia coli O157:H- str. H 2687; identical to SEQ ID NO: 5718

SEQ ID NO: 19374 - protein, 660 aa, Escherichia coli O157:H- str. H 2687; identical to SEQ ID NO: 11731

SEQ ID NO: 19375 - protein, 228 aa, Escherichia coli O157:H- str. H 2687; identical to SEQ ID NO: 11499

SEQ ID NO: 19376 - protein, 108 aa, Escherichia coli O157:H- str. H 2687; identical to SEQ ID NO: 11583

SEQ ID NO: 19377 - protein, 512 aa, Escherichia coli O157:H- str. H 2687; identical to SEQ ID NO: 5948

SEQ ID NO: 19378 - protein, 208 aa, Escherichia coli O157:H- str. H 2687; identical to SEQ ID NO: 5717

SEQ ID NO: 19379 - protein, 614 aa, Escherichia coli O157:H- str. H 2687; identical to SEQ ID NO: 5716

SEQ ID NO: 19380 - protein, 445 aa, Escherichia coli O157:H- str. H 2687; identical to SEQ ID NO: 12556

SEQ ID NO: 19381 - protein, 237 aa, Escherichia coli O157:H- str. H 2687; identical to SEQ ID NO: 5713

SEQ ID NO: 19382 - protein, 478 aa, Escherichia coli O157:H- str. H 2687
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQLMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 19383 - protein, 368 aa, Escherichia coli O157:H- str. H 2687; identical to SEQ ID NO: 11425

SEQ ID NO: 19384 - protein, 241 aa, Escherichia coli O157:H- str. H 2687; identical to SEQ ID NO: 5709

SEQ ID NO: 19385 - protein, 878 aa, Escherichia coli O157:H- str. H 2687; identical to SEQ ID NO: 5706

SEQ ID NO: 19386 - protein, 230 aa, Escherichia coli O157:H- str. H 2687; identical to SEQ ID NO: 5765

SEQ ID NO: 19387 - protein, 869 aa, Escherichia coli O157:H- str. H 2687; identical to SEQ ID NO: 5762

SEQ ID NO: 19388 - protein, 351 aa, Escherichia coli O157:H- str. H 2687; identical to SEQ ID NO: 5767

SEQ ID NO: 19389 - protein, 746 aa, Escherichia coli O157:H- str. H 2687; identical to SEQ ID NO: 5761

SEQ ID NO: 19390 - protein, 193 aa, Escherichia coli O157:H- str. H 2687; identical to SEQ ID NO: 5760

SEQ ID NO: 19391 - protein, 243 aa, Escherichia coli O157:H- str. H 2687; identical to SEQ ID NO: 8524

SEQ ID NO: 19392 - protein, 819 aa, Escherichia coli O157:H- str. H 2687; identical to SEQ ID NO: 19318

SEQ ID NO: 19393 - protein, 430 aa, Escherichia coli O157:H- str. H 2687; identical to SEQ ID NO: 5758

SEQ ID NO: 19394 - protein, 232 aa, Escherichia coli O157:H- str. H 2687; identical to SEQ ID NO: 5746

SEQ ID NO: 19395 - protein, 729 aa, Escherichia coli O157:H- str. H 2687; identical to SEQ ID NO: 5745

SEQ ID NO: 19396 - protein, 213 aa, Escherichia coli O157:H- str. H 2687; identical to SEQ ID NO: 5744

SEQ ID NO: 19397 - protein, 331 aa, Escherichia coli O157:H- str. H 2687; identical to SEQ ID NO: 6551

SEQ ID NO: 19398 - protein, 760 aa, Escherichia coli O157:H- str. H 2687; identical to SEQ ID NO: 5756

SEQ ID NO: 19399 - protein, 203 aa, Escherichia coli O157:H- str. H 2687; identical to SEQ ID NO: 6414

SEQ ID NO: 19400 - protein, 362 aa, Escherichia coli O157:H- str. H 2687; identical to SEQ ID NO: 5754

SEQ ID NO: 19401 - protein, 233 aa, Escherichia coli O157:H- str. H 2687; identical to SEQ ID NO: 5752

SEQ ID NO: 19402 - protein, 229 aa, Escherichia coli O157:H- str. H 2687; identical to SEQ ID NO: 11765

SEQ ID NO: 19403 - protein, 229 aa, Escherichia coli O157:H- str. H 2687; identical to SEQ ID NO: 11455

SEQ ID NO: 19404 - protein, 840 aa, Escherichia coli O157:H- str. H 2687; identical to SEQ ID NO: 11767

SEQ ID NO: 19405 - protein, 233 aa, Escherichia coli O157:H- str. H 2687; identical to SEQ ID NO: 11381

SEQ ID NO: 19406 - protein, 517 aa, Escherichia coli O157:H- str. H 2687; identical to SEQ ID NO: 6817

SEQ ID NO: 19407 - protein, 191 aa, Escherichia coli O157:H- str. H 2687; identical to SEQ ID NO: 5748

SEQ ID NO: 19408 - protein, 203 aa, Escherichia coli O157:H- str. H 2687; identical to SEQ ID NO: 6347

SEQ ID NO: 19409 - protein, 656 aa, Escherichia coli O157:H- str. H 2687; identical to SEQ ID NO: 11774

SEQ ID NO: 19410 - protein, 207 aa, Escherichia coli O157:H- str. H 2687; identical to SEQ ID NO: 5743

SEQ ID NO: 19411 - protein, 539 aa, Escherichia coli O157:H- str. H 2687; identical to SEQ ID NO: 6525

SEQ ID NO: 19412 - protein, 700 aa, Escherichia coli O157:H- str. H 2687; identical to SEQ ID NO: 5740

SEQ ID NO: 19413 - protein, 366 aa, Escherichia coli O157:H- str. H 2687; identical to SEQ ID NO: 11362

SEQ ID NO: 19414 - protein, 883 aa, Escherichia coli O157:H- str. H 2687
MTAFRAAFKAYRMHQVLLLPRFARLTIALSLATAVFPVDAEYYFNPRFLSNDLAESVDLSAFTKGREAPPGTYRVDIYLNDEFMTSRDITFITDDNNADLIPCLSTDLLVSLGIKKSALLDNKEHSAEKHVPDNSACTPLQDRLVDASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPRFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGATFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSTLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDNKLPEVSPGTLLNQQTAICR

SEQ ID NO: 19415 - protein, 239 aa, Escherichia coli O157:H- str. H 2687; identical to SEQ ID NO: 12299

SEQ ID NO: 19416 - protein, 118 aa, Escherichia coli O157:H43 str. T22 [sequence omitted]

SEQ ID NO: 19417 - protein, 102 aa, Escherichia coli O157:H43 str. T22; identical to SEQ ID NO: 7409

SEQ ID NO: 19418 - protein, 511 aa, Escherichia coli O157:H43 str. T22; identical to SEQ ID NO: 5749

SEQ ID NO: 19419 - protein, 191 aa, Escherichia coli O157:H43 str. T22; identical to SEQ ID NO: 5748

SEQ ID NO: 19420 - protein, 203 aa, Escherichia coli O157:H43 str. T22; identical to SEQ ID NO: 6414

SEQ ID NO: 19421 - protein, 203 aa, Escherichia coli O157:H43 str. T22; identical to SEQ ID NO: 6347

SEQ ID NO: 19422 - protein, 565 aa, Escherichia coli O157:H43 str. T22; identical to SEQ ID NO: 6492

SEQ ID NO: 19423 - protein, 207 aa, Escherichia coli O157:H43 str. T22; identical to SEQ ID NO: 5743

SEQ ID NO: 19424 - protein, 551 aa, Escherichia coli O157:H43 str. T22; identical to SEQ ID NO: 5742

SEQ ID NO: 19425 - protein, 729 aa, Escherichia coli O157:H43 str. T22; identical to SEQ ID NO: 6500

SEQ ID NO: 19426 - protein, 213 aa, Escherichia coli O157:H43 str. T22; identical to SEQ ID NO: 5744

SEQ ID NO: 19427 - protein, 700 aa, Escherichia coli O157:H43 str. T22; identical to SEQ ID NO: 7945

SEQ ID NO: 19428 - protein, 161 aa, Escherichia coli O157:H43 str. T22; identical to SEQ ID NO: 5769

SEQ ID NO: 19429 - protein, 518 aa, Escherichia coli O157:H43 str. T22; identical to SEQ ID NO: 7565

SEQ ID NO: 19430 - protein, 747 aa, Escherichia coli O157:H43 str. T22; identical to SEQ ID NO: 6343

SEQ ID NO: 19431 - protein, 170 aa, Escherichia coli O157:H43 str. T22 [sequence omitted]

SEQ ID NO: 19432 - protein, 412 aa, Escherichia coli O157:H43 str. T22; identical to SEQ ID NO: 6284

SEQ ID NO: 19433 - protein, 663 aa, Escherichia coli O157:H43 str. T22; identical to SEQ ID NO: 8669

SEQ ID NO: 19434 - protein, 36 aa, Escherichia coli O157:H43 str. T22
NNPNYGKAVPADFNGGSFGRGDSDEWTFGAQMEIWW

SEQ ID NO: 19435 - protein, 200 aa, Escherichia coli O157:H43 str. T22; identical to SEQ ID NO: 6311

SEQ ID NO: 19436 - protein, 232 aa, Escherichia coli O157:H43 str. T22; identical to SEQ ID NO: 5747

SEQ ID NO: 19437 - protein, 237 aa, Escherichia coli O157:H43 str. T22; identical to SEQ ID NO: 6533

SEQ ID NO: 19438 - protein, 193 aa, Escherichia coli O157:H43 str. T22; identical to SEQ ID NO: 6300

SEQ ID NO: 19439 - protein, 351 aa, Escherichia coli O157:H43 str. T22
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGGEDLVNYIDVGATYYFNKNMSAFVDYKINQLDSDNKLNINNDDIVAIGMTYQF

SEQ ID NO: 19440 - protein, 331 aa, Escherichia coli O157:H43 str. T22; identical to SEQ ID NO: 6551

SEQ ID NO: 19441 - protein, 614 aa, Escherichia coli O157:H43 str. T22; identical to SEQ ID NO: 7971

SEQ ID NO: 19442 - protein, 230 aa, Escherichia coli O157:H43 str. T22; identical to SEQ ID NO: 8315

SEQ ID NO: 19443 - protein, 798 aa, Escherichia coli O157:H43 str. T22
MDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 19444 - protein, 266 aa, Escherichia coli O157:H43 str. T22; identical to SEQ ID NO: 5772

SEQ ID NO: 19445 - protein, 362 aa, Escherichia coli O157:H43 str. T22; identical to SEQ ID NO: 5809

SEQ ID NO: 19446 - protein, 274 aa, Escherichia coli O157:H43 str. T22; identical to SEQ ID NO: 6549

SEQ ID NO: 19447 - protein, 231 aa, Escherichia coli O157:H43 str. T22; identical to SEQ ID NO: 6351

SEQ ID NO: 19448 - protein, 838 aa, Escherichia coli O157:H43 str. T22; identical to SEQ ID NO: 6447

SEQ ID NO: 19449 - protein, 432 aa, Escherichia coli O157:H43 str. T22; identical to SEQ ID NO: 5727

SEQ ID NO: 19450 - protein, 359 aa, Escherichia coli O157:H43 str. T22; identical to SEQ ID NO: 6332

SEQ ID NO: 19451 - protein, 430 aa, Escherichia coli O157:H43 str. T22; identical to SEQ ID NO: 5758

SEQ ID NO: 19452 - protein, 774 aa, Escherichia coli O157:H43 str. T22
MTPLRVFRKTTPLVNAIRLSLLPLASLSFSAFAAQVNIAPGSLDKALNQYAAHSGITLSVDASLTRGKQSNGLHGDYDVESGLQQLLDGSGLQVKPLGNNSWTLEPAPAPKEDALTVVGDWLGDARENDVFEHAGARDVIRSEDFAKTGATTMREVLNRIPGVSAPENNGTGSHDLAMNFGIRGLNPRLASRSTVLMDGIPVPFAPYGQPQLSLAPVSLGNMDAIDVVRGGGSVRYGPQSVGGVVNFVTRAIPQNFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGSHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFNQDYFIRSYDDNNKGIYAGQPRTLYMQGSLKF

SEQ ID NO: 19453 - protein, 208 aa, Escherichia coli O157:H43 str. T22; identical to SEQ ID NO: 5717

SEQ ID NO: 19454 - protein, 784 aa, Escherichia coli O157:H43 str. T22; identical to SEQ ID NO: 6283

SEQ ID NO: 19455 - protein, 760 aa, Escherichia coli O157:H43 str. T22; identical to SEQ ID NO: 16205

SEQ ID NO: 19456 - protein, 162 aa, Escherichia coli O157:H43 str. T22; identical to SEQ ID NO: 5896

SEQ ID NO: 19457 - protein, 406 aa, Escherichia coli O157:H43 str. T22
MITLRKLPLAVAVAAGVMSAQAMAVDFHGYARSGIGWTGSGGEQQCFQTTGAQSKYRLGNECETYAELKLGQEVWKEGDKSFYFDTNVAYSVAQQNDWEATDPAFREANVQGKNLIEWLPGSTIWAGKRFYQRHDVHMIDFYYWDISGPGAGLENIDVGFGKLSLAATRSSEAGGSSSFASNNIYDYTNETANDVFDVRLAQMEINPGGTLELGVDYGRANLRDNYRLVDGASKDGWLFTAEHTQSVLKGFNKFVVQYATDSMTSQGKGLSQGSGVAFDNEKFAYNINNNGHMLRILDHGAISMGDNWDMMYVGMYQDINWDNDNGTKWWTVGIRPMYKWTPIMSTVMEIGYDNVESQRTGDKNNQYKITLAQQWQAGDSIWSRPAIRVFATYAKWDEKWGYDYNG

SEQ ID NO: 19458 - protein, 708 aa, Escherichia coli O157:H43 str. T22
MKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARLSYSVNTGYTMNKASKDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 19459 - protein, 478 aa, Escherichia coli O157:H43 str. T22; identical to SEQ ID NO: 5711

SEQ ID NO: 19460 - protein, 368 aa, Escherichia coli O157:H43 str. T22; identical to SEQ ID NO: 7974

SEQ ID NO: 19461 - protein, 233 aa, Escherichia coli O157:H43 str. T22; identical to SEQ ID NO: 6327

SEQ ID NO: 19462 - protein, 810 aa, Escherichia coli O157:H43 str. T22
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGL

SEQ ID NO: 19463 - protein, 600 aa, Escherichia coli O157:H43 str. T22
MLRMTPLASAIVALLLGIEAYAAEETFDTHFMIGGMKDQQVANIRLDDNQPLPGQYDIDIYVNKQWRGKYEIIVKDNPQETCLSIEVIKRLGINSDNFASGKQCLTFEQLVQGGSYTWDIGVFRLDFSVLQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRFGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNWRRISYILAASQAYDENHHEEKRFNIFISIPFDWGDDVTTPRRQIYMSNSTTFDDQGFASNNTGLSGTVGSR

SEQ ID NO: 19464 - protein, 224 aa, Escherichia coli O157:H43 str. T22
MKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKVNNVKVNYETIMIAPLESQSVNVKSNNANNWYLTIIDDHGNYISDKI

SEQ ID NO: 19465 - protein, 760 aa, Escherichia coli O157:H43 str. T22
RTPIHLDLQWVLIDNQTAVCLTPEQLTLLGFTDEIIEVAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGVSLKSDENMLPPDLRGYAPQITGVAQTNAKVTVSQNNRIIYQENVPPGPFAITNLFNTLQGQLDVKVEEEDGQVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNKISHTASWYDSSDRNNSWSVSASGDNDEFKDMKASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIMGVIRLADGSHPPLGISVKDKTSHKELGLVADGGFVYLNGIQDDSKLTLRWGDKSCFIQPPNSSNLTTGTVILPCISQN

SEQ ID NO: 19466 - protein, 246 aa, Escherichia coli O157:H43 str. T22; identical to SEQ ID NO: 6342

SEQ ID NO: 19467 - protein, 570 aa, Escherichia coli O157:H43 str. T22
QLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGELT

SEQ ID NO: 19468 - protein, 338 aa, Escherichia coli O157:H43 str. T22
TNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 19469 - protein, 336 aa, Escherichia coli O157:H43 str. T22
TGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 19470 - protein, 138 aa, Escherichia coli O157:H43 str. T22
LAYLGNGDRAETYTGGLKYDANNIYLAAQYTQTYNATRVGSLGWANKAQNFEAVAQYQFDFGLRPSVAYLQSKGKNLGRNYDDEDILKYVDVGATYYFNKNMSTYVDYKINLLDDNQFTRDAGINTDNIVALGLVYQF

SEQ ID NO: 19471 - protein, 329 aa, Escherichia coli O157:H43 str. T22
GGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNV

SEQ ID NO: 19472 - protein, 169 aa, Escherichia coli O157:H43 str. T22
WAGGEVSTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAIAPCHVAWRAINDYGGLSAKKEQNLP

SEQ ID NO: 19473 - protein, 243 aa, Escherichia coli O157:H43 str. T22; identical to SEQ ID NO: 15477

SEQ ID NO: 19474 - protein, 998 aa, Escherichia coli O157:H7; identical to SEQ ID NO: 5606

SEQ ID NO: 19475 - protein, 89 aa, Escherichia coli O157:H7; identical to SEQ ID NO: 6233

SEQ ID NO: 19476 - protein, 898 aa, Escherichia coli O157:H7
MNTKMNERWRTPMKLKYLSCTILAPLAIGVFSATAADNNSAIYFNTSQPINDLQGSLAAEVKFAQSQILPAHPKEGDSQPHLTSLRKSLLLVRPVKADDKTPVQVEARDDNNKILGTLTLYPPSSLPDTIYHLDGVPEGGIDFTPHNGTKKIINTVAEVNKLSDASGSSIHSHLTNNALVEIHTANGRWVRDIYLPQGPDLEGKMVRFVSSAGYSSTVFYGDRKVTLSVGNTLLFKYVNGQWFRSGELENNRITYAQHIWSAELPAHWIVPGLNLVIKQGNLSGRLNDIKIGAPGELLLHTIDIGMLTTPRDRFDFAKDKEAHREYFQTIPVSRMIVNNYAPLHLKEVMLPTGELLTDMDPGNGGWHSGTMRQRIGKELVSHGIDNANYGLNSTAGLGENSHPYVVAQLAAHNSRGNYANGIQVHGGSGGGGIVTLDSTLGNEFSHEVGHNYGLGHYVDGFKGSVHRSAENNNSTWGWDGDKKRFIPNFYPSQTNEKSCLNNQCQEPFDGHKFGFDAMAGGSPFSAANRFTMYTPNSSAIIQRFFENKAVFDSRSSTGFSKWNADTQEMEPYEHTIDRAEQITASVNELSESKMAELMAEYAVVKVHMWNGNWTRNIYIPTASADNRGSILTINHEAGYNSYLFINGDEKVVSQGYKKSFVSDGQFWKERDVVDTREARKPEQFGVPVTTLVGYYDPEGTLSSYIYPAMYGAYGFTYSDDSQNLSDNDCQLQVDTKEGQLRFRLANHRANNTVMNKFHINVPTESQPTQATLVCNNKILDTKSLTPAPEGLTYTVNGQALPAKENEGCIVSVNSGKRYCLPVGQRSGYSLPDWIVGQEVYVDSGAKAKVLLSDWDNLSYNRIGEFVGNVNPADMKKVKAWNGQYLDFSKPRSMRVVYK

SEQ ID NO: 19477 - protein, 432 aa, Escherichia coli O157:H7; identical to SEQ ID NO: 5727

SEQ ID NO: 19478 - protein, 232 aa, Escherichia coli O157:H7; identical to SEQ ID NO: 5747

SEQ ID NO: 19479 - protein, 430 aa, Escherichia coli O157:H7; identical to SEQ ID NO: 5758

SEQ ID NO: 19480 - protein, 168 aa, Escherichia coli O157:H7; identical to SEQ ID NO: 7087

SEQ ID NO: 19481 - protein, 191 aa, Escherichia coli O157:H7; identical to SEQ ID NO: 5748

SEQ ID NO: 19482 - protein, 177 aa, Escherichia coli O157:H7; identical to SEQ ID NO: 7089

SEQ ID NO: 19483 - protein, 155 aa, Escherichia coli O157:H7; identical to SEQ ID NO: 7091

SEQ ID NO: 19484 - protein, 346 aa, Escherichia coli O157:H7; identical to SEQ ID NO: 7093

SEQ ID NO: 19485 - protein, 173 aa, Escherichia coli O157:H7; identical to SEQ ID NO: 7094

SEQ ID NO: 19486 - protein, 171 aa, Escherichia coli O157:H7; identical to SEQ ID NO: 7096

SEQ ID NO: 19487 - protein, 289 aa, Escherichia coli O157:H7; identical to SEQ ID NO: 7097

SEQ ID NO: 19488 - protein, 254 aa, Escherichia coli O157:H7; identical to SEQ ID NO: 7098

SEQ ID NO: 19489 - protein, 294 aa, Escherichia coli O157:H7; identical to SEQ ID NO: 7099

SEQ ID NO: 19490 - protein, 379 aa, Escherichia coli O157:H7; identical to SEQ ID NO: 7100

SEQ ID NO: 19491 - protein, 379 aa, Escherichia coli O157:H7; identical to SEQ ID NO: 7101

SEQ ID NO: 19492 - protein, 365 aa, Escherichia coli O157:H7; identical to SEQ ID NO: 7102

SEQ ID NO: 19493 - protein, 810 aa, Escherichia coli O157:H7; identical to SEQ ID NO: 6345

SEQ ID NO: 19494 - protein, 141 aa, Escherichia coli O157:H7; identical to SEQ ID NO: 7107

SEQ ID NO: 19495 - protein, 328 aa, Escherichia coli O157:H7; identical to SEQ ID NO: 7108

SEQ ID NO: 19496 - protein, 86 aa, Escherichia coli O157:H7; identical to SEQ ID NO: 7110

SEQ ID NO: 19497 - protein, 306 aa, Escherichia coli O157:H7; identical to SEQ ID NO: 7111

SEQ ID NO: 19498 - protein, 213 aa, Escherichia coli O157:H7; identical to SEQ ID NO: 5744

SEQ ID NO: 19499 - protein, 85 aa, Escherichia coli O157:H7; identical to SEQ ID NO: 7114

SEQ ID NO: 19500 - protein, 128 aa, Escherichia coli O157:H7
MRKSLLAILAVSSLVFSSASFAADLEDNMETLNDNLKVVEKADNAAQVKDALTKMRAAALDAQKATPPKLEDKSPDSPEMKDFRHGFDILVGQIDDALKLANEGKVKEAQAAAEQLKTTRNSYHKKYR

SEQ ID NO: 19501 - protein, 478 aa, Escherichia coli O157:H7; identical to SEQ ID NO: 5711

SEQ ID NO: 19502 - protein, 428 aa, Escherichia coli O157:H7; identical to SEQ ID NO: 7118

SEQ ID NO: 19503 - protein, 245 aa, Escherichia coli O157:H7 [sequence omitted]

SEQ ID NO: 19504 - protein, 237 aa, Escherichia coli O157:H7
MRHIFQRLLPRRLWLAGLPCLALLGCVQNHNKPAIDTPAEEKIPVYQLADYLSTECSDIWALQGKSTETNPLYWLRAMDCADRLMPAQSRQQARQYDDGSWQNTFKQGILLADAKITPYERRQLVARIEALSTEIPAQVRPLYQLWRDGQALQLQLAEERQRYSKLQQSSDSELDTLRQQHHVLQQQLELTTRKLENLTDIERQLSTRKPAGNFSPDTPHESEKPAPSTHEVTPDEP

SEQ ID NO: 19505 - protein, 157 aa, Escherichia coli O157:H7; identical to SEQ ID NO: 7120

SEQ ID NO: 19506 - protein, 367 aa, Escherichia coli O157:H7; identical to SEQ ID NO: 7121

SEQ ID NO: 19507 - protein, 130 aa, Escherichia coli O157:H7; identical to SEQ ID NO: 7124

SEQ ID NO: 19508 - protein, 185 aa, Escherichia coli O157:H7; identical to SEQ ID NO: 7125

SEQ ID NO: 19509 - protein, 355 aa, Escherichia coli O157:H7; identical to SEQ ID NO: 7130

SEQ ID NO: 19510 - protein, 208 aa, Escherichia coli O157:H7; identical to SEQ ID NO: 5717

SEQ ID NO: 19511 - protein, 236 aa, Escherichia coli O157:H7; identical to SEQ ID NO: 7133

SEQ ID NO: 19512 - protein, 248 aa, Escherichia coli O157:H7; identical to SEQ ID NO: 7136

SEQ ID NO: 19513 - protein, 110 aa, Escherichia coli O157:H7; identical to SEQ ID NO: 7137

SEQ ID NO: 19514 - protein, 260 aa, Escherichia coli O157:H7; identical to SEQ ID NO: 7138

SEQ ID NO: 19515 - protein, 161 aa, Escherichia coli O157:H7; identical to SEQ ID NO: 5769

SEQ ID NO: 19516 - protein, 396 aa, Escherichia coli O157:H7; identical to SEQ ID NO: 7140

SEQ ID NO: 19517 - protein, 91 aa, Escherichia coli O157:H7; identical to SEQ ID NO: 7141

SEQ ID NO: 19518 - protein, 91 aa, Escherichia coli O157:H7; identical to SEQ ID NO: 7142

SEQ ID NO: 19519 - protein, 190 aa, Escherichia coli O157:H7; identical to SEQ ID NO: 7146

SEQ ID NO: 19520 - protein, 330 aa, Escherichia coli O157:H7; identical to SEQ ID NO: 7147

SEQ ID NO: 19521 - protein, 318 aa, Escherichia coli O157:H7; identical to SEQ ID NO: 7148

SEQ ID NO: 19522 - protein, 438 aa, Escherichia coli O157:H7; identical to SEQ ID NO: 7150

SEQ ID NO: 19523 - protein, 645 aa, Escherichia coli O157:H7; identical to SEQ ID NO: 7152

SEQ ID NO: 19524 - protein, 173 aa, Escherichia coli O157:H7; identical to SEQ ID NO: 7154

SEQ ID NO: 19525 - protein, 337 aa, Escherichia coli O157:H7
MINNVSSLFPTVNRNITAVYKKSSFSVSPQKITLNPVKISSPFSPSSSSISATTLFRAPNAHSASFHRQSTAESSLHQQLPNVRQRLIQHLAEHGIKPARSMAEHIPPAPNWPAPPPPVQNEQSRPLPDVAQRLVQHLAEHGIQPARNMAEHIPPAPNWPAPPLPVQNEQSRPLPDVAQRLVQHLAEHGIQPARSMAEHIPPAPNWPAPPPPVQNEQSRPLPDVAQRLMQHLAEHGIQPARNMAEHIPPAPNWPAPTPPVQNEQSRPLPDVAQRLMQHLAEHGIQPARNMAEHIPPAPNWPAPTPPVQNEQSRPLPDVAQRLMQHLAEHGINTSKRS

SEQ ID NO: 19526 - protein, 337 aa, Escherichia coli O157:H7; identical to SEQ ID NO: 19525

SEQ ID NO: 19527 - protein, 934 aa, Escherichia coli O157:H7
MITHGCYTRTRHKHKLKKTLIMLSAGLGLFFYVNQNSFANGENYFKLGSDSKLLTHDSYQNRLFYTLKTGETVADLSKSQDINLSTIWSLNKHLYSSESEMMKAAPGQQIILPLKKLPFEYSALPLLGSAPLVAAGGVAGHTNKLTKMSPDVTKSNMTDDKALNYAAQQAASLGSQLQSRSLNGDYAKDTALGIAGNQASSQLQAWLQHYGTAEVNLQSGNNFDGSSLDFLLPFYDSEKMLAFGQVGARYIDSRFTANLGAGQRFFLPANMLGYNVFIDQDFSGDNTRLGIGGEYWRDYFKSSVNGYFRMSGWHESYNKKDYDERPANGFDIRFNGYLPSYPALGAKLIYEQYYGDNVALFNSDKLQSNPGAATVGVNYTPIPLVTMGIDYRHGTGNENDLLYSMQFRYQFDKSWSQQIEPQYVNELRTLSGSRYDLVQRNNNIILEYKKQDILSLNIPHDINGTEHSTQKIQLIVKSKYGLDRIVWDDSALRSQGGQIQHSGSQSAQDYQAILPAYVQGGSNIYKVTARAYDRNGNSSNNVQLTITVLSNGQVVDQVGVTDFTADKTSAKADNADTITYTATVKKNGVAQANVPVSFNIVSGTATLGANSAKTDANGKATVTLKSSTPGQVVVSAKTAEMTSALNASAVIFFDQTKASITEIKADKTTAVANGKDAIKYTVKVMKNGQPVNNQSVTFSTNFGMFNGKSQTQATTGNDGRATITLTSSSAGKATVSATVSDGAEVKATEVTFFDELKIDNKVDIIGNNVRGELPNIWLQYGQFKLKASGGDGTYSWYSENTSIATVDASGKVTLNGKGSVVIKATSGDKQTVSYTIKAPSYMIKVDKQAYYADAMSICKNLLPSTQTVLSDIYDSWGAANKYSHYSSMNSITAWIKQTSSEQRSGVSSTYNLITQNPLPGVNVNTPNVYAVCVE

SEQ ID NO: 19528 - protein, 341 aa, Escherichia coli O157:H7
MKKMMIATLAAASVLLAVANQAHAGATLDAVQKKGFVQCGISDGLPGFSYADADGKFSGIDVDVCRGVAAAVFGDDTKVKYTPLTAKERFTALQSGEVDLLSRNTTWTSSRDAGMGMAFTGVTYYDGIGFLTHDKAGLKSAKELDGATVCIQAGTDTELNVADYFKANNMKYTPVTFDRSDESAKALESGRCDTLASDQSQLYALRIKLSNPAEWIVLPEVISKEPLGPVVRRGDDEWFSIVRWTLFAMLNAEEMGINSQNVDEKAANPATPDMAHLLGKEGDYGKDLKLDNKWAYNIIKQVGNYSEIFERNVGSESPLKIKRGQNNLWNNGGIQYAPPVR

SEQ ID NO: 19529 - protein, 365 aa, Escherichia coli O157:H7
MIKFLSALILLLVTTAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINSRTGSVVMNREVTLDSCAIAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 19530 - protein, 246 aa, Escherichia coli O157:H7
MLINRNIVALFALPFMASATASELSIGAGAAYNESPYRGYNENTKAIPLISYEGDSFYVRQTTLGFILSQSEKNELSLTASWMPLEFDPADNDDYAMQQLDKRDSTAMAGVAWYHHERWGTVKASAAADVLDNSNGWVGELSVFHKMQIGRLSLTPALGVLYYDENFSDYYYGISESESRRSGLASYSAQDAWVPYVSLTAKYPIGEHVVLMASAGYSELPEEITDSPMIDRNESFTFVTGVSWRF

SEQ ID NO: 19531 - protein, 313 aa, Escherichia coli O157:H7
MISDSKLLASAAWDAQSLNELKAKASEDPAANIRPVARQVEGMFVQMMLKSMRDALPKDGLFSSEHTRLYTSMYDQQIAQQMTTGKGLGLAEMMVKQMTPEQPLPEESTPAAPMKFPLETVVRYQNQALSQLVQKAVPRNYDDSLPGDSKAFLAQLSLPAQLASQQSGVPHHLILAQAALESGWGQRQIRRENGEPSYNLFGVKASGNWKGPVTEITTTEYENGEAKKVKAKFRVYSSYLEALSDYVGLLTRNPRYAAVTTAASAEQGAQALQDAGYATDPHYARKLTNMIQQMKSISDKVSKTYSMNIDNLF

SEQ ID NO: 19532 - protein, 465 aa, Escherichia coli O157:H7
MASISSLGVGSGLDLSSILDSLTAAQKATLTPISNQQSSFTAKLSAYGTLKSALTTFQTANTALSKADLFSATSSTTAFSATTAGNAIAGKYTISVTHLAQAQTLTTRTTRDDTKTAIATSDSKLTIQQGGDKDPITIDISAANSSLSGIRDAINNAKAGVSASIINVGNGDYRLSVTSNDTGLDNAMTLSVSGDDALQSFMGYDASASSNGMEVSVAAQNAQLTVNNVAIENSSNTISDALENITLNLNDVTTGNQTLTITQDTSKAQTAIKDWVNAYNSLIDTFSSLTKYTAVDAGADSQSSSNGALLGDSTLRTIQTQLKSMLSNTVSSSSYKTLAQIGITTDPSDGKLELDADKLTAALKKDASGVGALIVGDGKKTGITTTIGSNLTSWLSTTGIIKAATDGVSKTLNKLTKDYNAASDRIDAQVARYKEQFTQLDVLMTSLNSTSSYLTQQFENNSNSK

SEQ ID NO: 19533 - protein, 248 aa, Escherichia coli O157:H7
MLKKILLLALLPAIAFAEELPAPVKAIEKQGITIIKTFDAPGGMKGYLGKYQDMGVTIYLTPDGKHAISGYMYNEKGENLSNTLIEKEIYAPAGREMWQRMEQSHWLLDGKKDAPVIVYVFADPFCPYCKQFWQQARPWVDSGKVQLRTLLVGVIKPESPATAAAILASKDPAKTWQEYEASGGKLKLNVPANVSTEQMKVLSDNEKLMDDLGANVTPAIYYMSKENTLQQAVGLPDQKTLNIIMGNK

SEQ ID NO: 19534 - protein, 342 aa, Escherichia coli O157:H7
MRVLLFLLLSLFMLPAFSADNLLRWHDAQHFTVQASMPLKAKRVWKLCALYPSLKDSYWLSLNYGMQEAARRYGVDLKVLEAGGYSQLATQQAQIDQCKQWGAEAILLGSSTTSFPDLQKQVANLPVIELVNAIDAPQVKSRVGVPWFQMGYQPGRYLVQWAHGKPLNVLLMPGPDNAGGSKEMVEGFRAAIAGSPVRIVDIALGDNDIEIQRNLLQEMLERHPEIDVVAGTAIAAEAAMGEGRNLKTPLTVVSFYLSHQVYRGLKRGRVIMAASDQMVWQGELAVEQAIRQLQGQSVSDNVSPPILVLTPKNADREHIRRSLSPGGFRPVYFYQHTSAAKK

SEQ ID NO: 19535 - protein, 848 aa, Escherichia coli O157:H7
MNNNDLFQASRRRFLAQLGGLTVAGMLGPSLLTSRRATAAQAATEAVISKEGILTGSHWGAIRATVKDGRFVAAKPFELDKYPSKMIAGLPDHVHNAARIRYPMVRVDWLRKRHLSDTSQRGDNRFVRVSWDEALDMFYEELERVQKTHGPSALLTASGWQSTGMFHNASGMLAKAIALHGNSVGTGGDYSTGAAQVILPRVVGSMEVYEQQTSWPLVLQNSKTIVLWGSDLLKNQQANWWCPDHDVYEYYAQLKAKVAAGEIEVISIDPVVTSTHEYLGREHVKHIAVNPQTDVPLQLALAHTLYSENLYDKNFLANYCVGFEQFLPYLLGEKDGQPKDAAWAEKLTGIDAETIRGLARQMAANRTQIIAGWCVQRMQHGEQWAWMIVVLAAMLGQIGLPGGGFGFGWHYNGAGTPGRKGVILSGFSGSTSIPPVHDNSDYKGYSSTIPIARFIDAILEPGKVINWNGKSVKLPPLKMCIFAGTNPFHRHQQINRIIEGWRKLETVIAIDNQWTSTCRFADIVLPATTQFERNDLDQYGNHSNRGIIAMKQVVPPQFEARNDFDIFRELCRRFNREEAFTEGLDEMGWLKRIWQEGVQQGKGRGVHLPAFDDFWNNKEYVEFDHPQMFVRHQAFREDPDLEPLGTPSGLIEIYSKTIADMNYDDCQGHPMWFEKIERSHGGPGSQTYPLHLQSVHPDFRLHSQLCESETLRQQYTVAGKEPVFINPQDASARGIRNGDVVRVFNARGQVLAGAVVSDRYAPGVARIHEGAWHDPDKGGEPGALCKYGNPNVLTIDIGTSQLAQATSAHTTLVEIEKCNGTVEQVTAFNGPVEMVAQCEYVPASQVKL

SEQ ID NO: 19536 - protein, 809 aa, Escherichia coli O157:H7
MTLTRREFIKHSGIAAGALVVTSAAPLPAWAEEKGGKILTAGRWGAMNVEVKDGKIVSSTGALAKTIPNSLQSTAADQVHTTARIQHPMVRKSYLDNPLQPAKGRGEDTYVQVSWEQALKLIHEQHERIRKANGPSAIFAGSYGWRSSGVLHKAQTLLQRYMNLAGGYSGHSGDYSTGAAQVIMPHVVGSVEVYEQQTSWPLILENSQVVVLWGMNPLNTLKIAWSSTDEQGLEYFHQLKKSGKPVIAIDPIRSETIEFFGYNATWIAPNMGTDVALMLGIAHTLMTQGKHDKVFLEKYTTGYPQFEEYLTGKSDNTPKSAAWTAEITGVPEAQIVKLAELMAANRTMLMAGWGIQRQQYGEQKHWMLVTLAAMLGQIGTPGGGFGFSYHYSNGGNPTRVGGVLPEMSAAIAGQASEAADDGGMTAIPVARIVDALENPGGKYQHNGKEQTYPNIKMIWWAGGGNFTHHQDTNRLIKAWQKPEMIVVSECYWTAAAKHADIVLPITTSFERNDLTMTGDYSNQHIVPMKQAVAPQFEARNDFDVFAELAELLKPGGKEIYTEGKDEMAWLKFFYDAAQKGARAQRVTMPMFNAFWQQNKLIEMRRSEKNEQYVRYGDFRADPVKNALGTPSGKIEIYSKTLEKFGYKDCPAHPTWLAPDEWKGTADEKQLQLLTAHPAHRLHSQLNYAQLRKKYAVADREPITIHTEDAARFGIANGDLVRVWNKRGQILTGAVVTDGIKKGVVCVHEGAWPDLENGLCKNGSANVLTADIPSSQLANACAGNSALVYIEKYTGNAPKLTAFDQPAVQA

SEQ ID NO: 19537 - protein, 317 aa, Escherichia coli O157:H7
MRAKLLGIVLTTPIAISSFASTETLSFTPDNINADISLGTLSGKTKERVYLAEEGGRKVSQLDWKFNNAAIIKGAINWDLMPQISIGAAGWTTLGSRGGNMVDQDWMDSSNPGTWTDESRHPDTQLNYANEFDLNIKGWLLNEPNYRLGLMAGYQESRYSFTARGGSYIYSSEEGFRDDIGSFPNGERAIGYKQRFKMPYIGLTGSYRYEDFELGGTFKYSGWVEASDNDEHYDPGKRITYRSKVKDQNYYSVSVNAGYYVTPNAKVYVEGTWNRVTNKKGNTSLYDHNDNTSDYSKNGAGIENYNFITTAGLKYTF

SEQ ID NO: 19538 - protein, 203 aa, Escherichia coli O157:H7; identical to SEQ ID NO: 6414

SEQ ID NO: 19539 - protein, 207 aa, Escherichia coli O157:H7; identical to SEQ ID NO: 5743

SEQ ID NO: 19540 - protein, 170 aa, Escherichia coli O157:H7; identical to SEQ ID NO: 5855

SEQ ID NO: 19541 - protein, 191 aa, Escherichia coli O157:H7; identical to SEQ ID NO: 7278

SEQ ID NO: 19542 - protein, 270 aa, Escherichia coli O157:H7
MKSLFKVTLLATTMAVALHAPITFAAEAAKPATTADSKAAFKNDDQKSAYALGASLGRYMENSLKEQEKLGIKLDKDQLIAGVQDAFADKSKLSDQEIEQTLQAFEARVKSSAQAKMEKDAADNEAKGKEYREKFAKEKGVKTSSTGLVYQVVEAGKGEAPKDSDTVVVNYKGTLIDGKEFDNSYTRGEPLSFRLDGVIPGWTEGLKNIKKGGKIKLVIPPELAYGKAGVPGIPPNSTLVFDVELLDVKPAPKADAKPEADAKAADSAKK

SEQ ID NO: 19543 - protein, 511 aa, Escherichia coli O157:H7; identical to SEQ ID NO: 5749

SEQ ID NO: 19544 - protein, 807 aa, Escherichia coli O157:H7; identical to SEQ ID NO: 7282

SEQ ID NO: 19545 - protein, 372 aa, Escherichia coli O157:H7; identical to SEQ ID NO: 7283

SEQ ID NO: 19546 - protein, 78 aa, Escherichia coli O157:H7; identical to SEQ ID NO: 7284

SEQ ID NO: 19547 - protein, 238 aa, Escherichia coli O157:H7; identical to SEQ ID NO: 7285

SEQ ID NO: 19548 - protein, 998 aa, Escherichia coli O157:H7; identical to SEQ ID NO: 6058

SEQ ID NO: 19549 - protein, 878 aa, Escherichia coli O157:H7; identical to SEQ ID NO: 5707

SEQ ID NO: 19550 - protein, 229 aa, Escherichia coli O157:H7; identical to SEQ ID NO: 11418

SEQ ID NO: 19551 - protein, 879 aa, Escherichia coli O157:H7
MPDHSLFRLRVLPCCVALAMSGSYVNAWAENEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDITHSHTRLDKETAYGKGSLDGNSFRLSYSKDFDELNSRVTFAGYRFSEENFMTMSEYLDASDSEMVRTGNDKEMYTATYNQNFRDAGVSVYLNYTRHTYWDRDEQTNYNVMLSHYFNLGSIRNMSISMTGYRYEYDNQADKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQGTLTEGAIGYRKFSVISGQKAMAVLRLQDGSYPPFGAEVKNDSAQNVGLVDDDGNVYLAGVKPGEHMIVSWGGVAHCDIHLPDPLPADLFNGLLLPCQQTGAISPSMPHEIKPVIQEQTQQVMPTEAPVSVSAN

SEQ ID NO: 19552 - protein, 659 aa, Escherichia coli O157:H7; identical to SEQ ID NO: 5736

SEQ ID NO: 19553 - protein, 715 aa, Escherichia coli O157:H7; identical to SEQ ID NO: 11710

SEQ ID NO: 19554 - protein, 191 aa, Escherichia coli O157:H7; identical to SEQ ID NO: 5701

SEQ ID NO: 19555 - protein, 236 aa, Escherichia coli O157:H7; identical to SEQ ID NO: 11364

SEQ ID NO: 19556 - protein, 700 aa, Escherichia coli O157:H7; identical to SEQ ID NO: 5740

SEQ ID NO: 19557 - protein, 656 aa, Escherichia coli O157:H7; identical to SEQ ID NO: 11390

SEQ ID NO: 19558 - protein, 729 aa, Escherichia coli O157:H7; identical to SEQ ID NO: 5745

SEQ ID NO: 19559 - protein, 233 aa, Escherichia coli O157:H7; identical to SEQ ID NO: 11381

SEQ ID NO: 19560 - protein, 840 aa, Escherichia coli O157:H7; identical to SEQ ID NO: 11380

SEQ ID NO: 19561 - protein, 209 aa, Escherichia coli O157:H7; identical to SEQ ID NO: 11379

SEQ ID NO: 19562 - protein, 723 aa, Escherichia coli O157:H7
MDAVNIYRLSVLSCLAMVTPPALTAEFNLNVLDKSIRDSVDISLLNQKGVVAPGDYFVSVTVNNNKISNGQQIRWQKSGDKIIPCINESLIELFGLKSDFRKKLPAIKECVDFSVFPEIIFTFDQANQQLNITIPQAWLAWHSENWTPPSTWNNGIPGFLMDYNLFASTYRPQSGSSSNNLNAYGTTGLNAGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLAAGRPRSSMSHHTEDETFISHEVSWGMLSNTSLYGGMLLAGDDYRSGALGIGQNMLWMGALSFDVTWADSHFDTQQDEQGYSYRFNYSKQVDATNSTISLAAYRFSDRHFHSYANYIDHKYNDADAQDEKQTISLSFGQPITLLNLNLYANILHQSWWNADTSTTANITVGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGAAFHRRSSTNEPRLMVSTDGVGDIPIQGNIDYTNRFGIAVVPFVSSYQPTTVAVNMNDLPDGVTVSENVVKET

SEQ ID NO: 19563 - protein, 869 aa, Escherichia coli O157:H7; identical to SEQ ID NO: 5763

SEQ ID NO: 19564 - protein, 241 aa, Escherichia coli O157:H7; identical to SEQ ID NO: 11431

SEQ ID NO: 19565 - protein, 1300 aa, Escherichia coli O157:H7
MNKIYSLKYSHITGGLIAVSELSGRVSSRATGKKKHKRILALCFLGLLQSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKYSYNVDMSGAQVATIENGKLTGTGSDTTDIKNKDLIFTGGGDILLKSSFDNGAGGLVFNDKKTYRVNGDDFTFKGAGVDTRNGSTVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAVITNTSTKKSILSLNNTADYIYHGNINGNLDVLQHHETKKENRRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSVGRNANVIGDIQASKSNITIGDTTAYIDLHAGKNITGDGFGFRQNIVRGNSQGETLFTGGITAEDSTIVIKDKAKALFSNYVYLLNTKATIENGADVTTQSGMFSTSDISISGNLSMTGNPDKDNKFEPSIYLNDASYLLTDDSARLVAKNKASVVGDIHSTKSASIMFGHDESDLSQLSDRTSKGLALGLLGGFDVSYRGSVNAPSASATMNNTWWQLTGDSALKTLKSTNSMVYFTDSANNKKFHTLTVDELATSNSAYAMRTNLSESDKLEVKKHLSGENNILLVDFLQKPTPEKQLNIELVSAPKDTNENVFKASKQTIGFSDVTPVITTRETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEAGYRYHVTEDAWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSVGLNAEIRDNVRFGLEFEKSAFGKYNVDNAVNANFRYSF

SEQ ID NO: 19566 - protein, 736 aa, Escherichia coli O157:H7
MIKKTLPVLILLALSGSFSTAVAADKKETQNFYYPETLDLTPLRLHSPESNPWGADFDYATRFQQLDMEALKKDIKDLLTTSQDWWPADYGHYGPFFIRMAWHGAGTYRTYDGRGGASGGQQRFEPLNSWPDNVNLDKARRLLWPVKKKYGSSISWGDLMVLTGNVALESMGFKTLGFAGGREDDWESDLVYWGPDNKPLADNRDKNGKLQKPLAATQMGLIYVNPEGPGGKPDPLASAKDIREAFSRMAMDDEETVALIAGGHTFGKAHGAASPEKCIGAGPDGAPVEEQGLGWKNKCGTGNGKYTITSGLEGAWSTSPTQFTMQYLKNLYKYEWELHKSPAGAYQWKPKKAANIVQDAHDPSVLHPLMMFTTDIALKVDPEYKKITTRFLNDPKAFEQAFARAWFKLTHRDMGPAARYLGNEVPAESFIWQDPLPAADYTMIDGKDIKSLKEQVMDLGIPASELIKTAWASASTFRVTDYRGGNNGARIRLQPEINWEVNEPEKLKKVLASLTSLQREFNKKQSDGKKVSLADLIVLSGNAAIEDAARKAGVELEIPFTPGRTDASQEQTDVASFSVLEPTADGFRNYYSKSRSHISPVESLIDKASQLDLTVPEMTALLGGLRVMDINTNNSSLGVFTDTPGVLDNKFFVNLLDMSTRWSKADKEDTYNGFDRKTGALKWKASSVDLIFSSNPELRAVAEVYASDDARNKFIHDFVKSWNKVMNSDRFDLNNK

SEQ ID NO: 19567 - protein, 512 aa, Escherichia coli O157:H7; identical to SEQ ID NO: 5948

SEQ ID NO: 19568 - protein, 558 aa, Escherichia coli O157:H7; identical to SEQ ID NO: 5974

SEQ ID NO: 19569 - protein, 660 aa, Escherichia coli O157:H7; identical to SEQ ID NO: 6039

SEQ ID NO: 19570 - protein, 89 aa, Escherichia coli O157:H7; identical to SEQ ID NO: 6232

SEQ ID NO: 19571 - protein, 89 aa, Escherichia coli O157:H7; identical to SEQ ID NO: 6053

SEQ ID NO: 19572 - protein, 585 aa, Escherichia coli O157:H7; identical to SEQ ID NO: 5937

SEQ ID NO: 19573 - protein, 89 aa, Escherichia coli O157:H7
MKKTLLITASLSFFSASALATPDCVTGKVEYTKYNDDDTFTVKVGDKELFTNRWNLQSLLLSAQITGMTVTIKTNACHNGGGFSEVIFR

SEQ ID NO: 19574 - protein, 122 aa, Escherichia coli O157:H7
SQNDIAKSSIELINQLVDTVSSINSTVDSFSEQLNQLGSFLSSKPRLSSVGGKLQNLPDLGPLGDGLDVVSGILSAVSASFILGNSDAHTGTKAAAGIELTTQVLGNVGKAVSQYILAQRMA

SEQ ID NO: 19575 - protein, 407 aa, Escherichia coli O157:H7
MTERELSIIRALGEEFSTVLADLQRTFEGKMAAQAQAFEEKLASLSAVLQKHVTVDEVHPVLQAMVDDAVGTIPVPRDGRDYDPDVLQQAVNDAVANIPVPADGKSITPDDVRPMLEQMVKEAVSHIPAPRDGRDYDPEVLKQAVNDAVANIPVPADGKSITPDDVRPMLEQMVKEAVSHIPAPRDGRDYDPEVLKQAVNDAVANIPVPADGKSITPDDVRPMLEQMVKEAVSHIPVPRDGRDYDPDVLQKAVLDAVRALPAPQDGRDATALEIIPAIDDQKSFPRGTYATHQGGLWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRDAGGGK

SEQ ID NO: 19576 - protein, 224 aa, Escherichia coli O157:H7; identical to SEQ ID NO: 11398

SEQ ID NO: 19577 - protein, 861 aa, Escherichia coli O157:H7
  MOD_RES (48)..(48): Any amino acid
  MOD_RES (50)..(50): Any amino acid
  MOD_RES (57)..(57): Any amino acid
  MOD_RES (302)..(302): Any amino acid
  MOD_RES (483)..(483): Any amino acid
  MOD_RES (485)..(485): Any amino acid
  MOD_RES (487)..(487): Any amino acid
  MOD_RES (491)..(491): Any amino acid
  MOD_RES (497)..(497): Any amino acid
  MOD_RES (499)..(499): Any amino acid
  MOD_RES (501)..(501): Any amino acid
  MOD_RES (506)..(506): Any amino acid
  MOD_RES (509)..(509): Any amino acid
  MOD_RES (511)..(511): Any amino acid
  MOD_RES (515)..(515): Any amino acid
  MOD_RES (518)..(518): Any amino acid
  MOD_RES (521)..(522): Any amino acid
  MOD_RES (525)..(526): Any amino acid
MWNLLRRTRKNQKSGRDVREVGWRSLFQAVAEPFAGAWQQGVKADPEXVXSFHAVFXCISLISQDIAKMRLRLMQTDAHGIRRETRRGDIARLCRRPNAQQNRIQFFELWLNAKLRHGNTVVLKIRNARGQIKELRILDWSRVEPLVADDGEVFYRITPDRNCGITEAVTVPAREVIHDRFNCFFHPLIGLPPVYAAGLAATQGHHIQENSTSFFRNGGRPSGVIEIPGSITEENAKKLKSNWDSGYTGENAGKTAILSNGAKYNPTTFSPVDAQTVEQLKMTAEIVCSVFRVPAYKIGVGXPPSSDNVEALEQQYYSQCLQTLIESIELLLDEALETGENESTEFDVTTLLRMDSERRMKTLGDAVKNTLLTPNEARKRENLPPLAGGDALYLQQQNYSLEALSRRDAREDPFASAGKTVSSQLPDGASDGNKAISETEHDAVKAMFRGDTEKMTERELSIIRALGEEFSTVLADLQRTFEXKXAXQAQXFEEKLXSXSXVLQKXVTXDXVRPXLZXMVXXAVXXIPVPRDGRDYDPDVLQKAVNDAVANIPVPADGKSITPDDVRPMLEQMVKEAVSHIPVPRDGRDYDPDVLQKAVNDAVAKIPVPADGKSITPDDVHPMLEQMVKEAVSHIPVPRDGRDYDPDVLQKAVNDAVAKIPVPADGKSITPDDVHPMLEQMVKEAVSHIPVPRDGRDYDPDVLQKAVLEAVSALPAPQDGRDATALEILPAIDDQKSFPRGSYATHQGGLWRAYEKTYGMRGWECLVDGVADIDVSMTGERSFSVVVRQSSGQRTEKTFSLPVMLYRGVFRIGETYHPGDTVTWGGSLWHCNSMTGDKPGEAHSSGWTLAAKRGRDAGGGK

SEQ ID NO: 19578 - protein, 240 aa, Escherichia coli O157:H7
  MOD_RES (24)..(24): Any amino acid
MAAIFMAASINIRGIKMKGLLSLXISSMIFPAHAGMVIFGTRIIYPAEQKEVMVQLMNQGNRSSLMQAWIDDGDTSLPPEKIQVPFMLTPPVVKVAANSGQQIKIKIMPNKLPSNKESIFYLNVLDIPPNSPEDEGKNALKFAMQNRIKLFYRPAGIAPVNKTTFKKLRVSRSGNNVVIKNDSPNWVTISDVKANNVKVNYETIMIAPQESQNVSEKNNNANGWQLTIIDDHGNYISDKI

SEQ ID NO: 19579 - protein, 384 aa, Escherichia coli O157:H7
  MOD_RES (97)..(97): Any amino acid
  MOD_RES (205)..(205): Any amino acid
  MOD_RES (207)..(207): Any amino acid
  MOD_RES (276)..(276): Any amino acid
  MOD_RES (304)..(305): Any amino acid
  MOD_RES (308)..(308): Any amino acid
  MOD_RES (316)..(316): Any amino acid
  MOD_RES (320)..(320): Any amino acid
  MOD_RES (348)..(348): Any amino acid
MINNVSSLFPTVNRNITAVYKKSSFSVSPQKITLNPVKISSPFSPSSSSISATTLFRAPNAHSASFHRQSTAESSLHQQLPNVRQRLIQHLAEHGIXPARSMAEHIPPAPKWPAPPPPVQNEQSRPLPDVAQRLMQHLAEHGIQPARNMAEHIPPAPNWPAPTPPVQNEQSRPLPDVAQRLMQHLAEHGIQPARNMAEHIPPAPXWXAPTPPVQNEQSRPLPDVAQRLMQHLAEHGIZPARSMAEHIPPAPNWPAPPPPVQNEQSRPLPDVAQRLXQHLAEHGIQPARNMAEHIPPAPNWPAPXXPVXNEQSRPLXDVAXRLMQHLAEHGIQPARNMAEHIPPAPNWXAPTPPVQNEQSRPLPDVAQRLMQHLAEHGINTSKRS

SEQ ID NO: 19580 - protein, 316 aa, Escherichia coli O157:H7
  MOD_RES (107)..(107): Any amino acid
MMRLRIFRYRRTAKCITPDDVRPMLEQMVKKAVSHIPAPRDGRDYDPEVLKQAVNDAVANIPVPADGKSITPDDVRPMLEQMVKEAVSHIPAPRDGRDYDPEVLKQXVNDAVANIPVPADGKSITPBDVRPMLEQMVKEAVSHIPVPRDGRDYDPDVLQKAVLDAVRALPAPQDGRDATALEIIPAIDDQKSFPRGTYATHQGGLWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRDAGGGK

SEQ ID NO: 19581 - protein, 368 aa, Escherichia coli O157:H7; identical to SEQ ID NO: 11425

SEQ ID NO: 19582 - protein, 241 aa, Escherichia coli O157:H7; identical to SEQ ID NO: 5709

SEQ ID NO: 19583 - protein, 229 aa, Escherichia coli O157:H7; identical to SEQ ID NO: 11455

SEQ ID NO: 19584 - protein, 233 aa, Escherichia coli O157:H7; identical to SEQ ID NO: 5752

SEQ ID NO: 19585 - protein, 232 aa, Escherichia coli O157:H7
  MOD_RES (223)..(223): Any amino acid
MDRMMKSKFVALALSLFLSQSVLAGGVGLSSTRVIYDGSKKEASLTVQNKSKTEEFLIQSWVDDAAGSKKTPFIITPPLFKLDPEKNNILRIVNITPGLPQDRESVYWVNVKAIPSKSDDSENKNVLQIAVRTRIKLFYRPAGLKGDVKTAPNELRFTRNGNQLRVDNPTVFNITFNQFFANDKEIEKAGMVPAKGALNITLPAGVGSVSKIKYNTINDFGSXAEMITKNVD

SEQ ID NO: 19586 - protein, 367 aa, Escherichia coli O157:H7; identical to SEQ ID NO: 11417

SEQ ID NO: 19587 - protein, 368 aa, Escherichia coli O157:H7
MNVLRSGLVTMLLLAAFSVQAACTWPAWEQFKKDYISQEGRVIDPSDARKITTSEGQSYGMFFALAANDRAAFDNILDWTQNNLAQGSLKERLPAWLWGKKENSKWEVLDSNSASDGDVWMAWSLLEAGRLWKEQRYTDIGSALLKRIAREEVVTVPGLGSMLLPGKVGFAEDNSWRFNPSYLPPTLAQYFTRFGAPWTTLRETNQRLLLETAPKGFSPDWVRYEKDKGWQLKAEKTLISSYDAIRVYMWVGMMPDSDPQKARMLNRFKPMATFTEKNGYPPEKVDVATGKAQGKGPVGFSAAMLPFLQNRDAQAVQRQRVADNFPGSDAYYNYVLTLFGQGWDQHRFRFSTKGELLPDWGQECANSH

SEQ ID NO: 19588 - protein, 488 aa, Escherichia coli O157:H7
MINRQLSRLLLCSILGSTTLISGCALVRKDSAPHQQLKPEQIKLADDIHLASSGWPQAQWWKQLNDPQLDALIQRTLSGSHTLAEAKLREEKAQSQADLLDAGSQLQVAALGMLNRQRVSANGFLSPYAMDAPALGMDGPYYTEATVGLFAGLDLDLWGVHRSAVTAAIGAHNAALAETAAVELSLTTGVAQLYYSMQASYQMLDLLEQTRDVIDYAVKAHQSKVAHGLEAQVPFHGARAQILAVDKQIAAVKGQITETRESLRALIGAGASDMPEIKPVALPRVQTGIPATLSYELLARRPDLQAMRWYVQASLDQVDSARALFYPSFDIKAFFGLDSIHLDTLFKKTSRQFNFIPGLKLPLFDGGRLNANLEGTRAASNMMIERYNQSVLNAVRDVAVNGTRLQTLNDEREMQAERVEATRFTQRAAEAAYQRGLTSRLQATEARLPVLAEEMSLLMLDSRRVIQSIQLMKSLGSGYQAAPVVEKK

SEQ ID NO: 19589 - protein, 127 aa, Escherichia coli O157:H7
MYKGLLTLLLLFTCFARAQVVDTWQFANPQQQQQALNIASQLRCPQCQNQNLLESNAPVAVSMRHQVYSMVAEGKSEVEIIGWMTERYGDFVRYNPPLTGQTLVLWALPVVLLLLMALILWRVRAKR

SEQ ID NO: 19590 - protein, 237 aa, Escherichia coli O157:H7; identical to SEQ ID NO: 5713

SEQ ID NO: 19591 - protein, 446 aa, Escherichia coli O157:H7; identical to SEQ ID NO: 5714

SEQ ID NO: 19592 - protein, 659 aa, Escherichia coli O157:H7
  MOD_RES (421)..(421): Any amino acid
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAXSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 19593 - protein, 478 aa, Escherichia coli O157:H7
MNRDSFYPAIACFPLLLMLAGCAPMHETRQALSQQTPAAQVDTALPTALKNGWPDSQWWLEYHDNQLTSLINNALQNAPDMQVAEQRIQLAEAQAKAVATQDGPQIDFSADMERQKMSAEGLMGPFALNDPAAGTTGPWYTNGTFGLTAGWHLDIWGKNRAEVTARLGTVKARAAEREQTRQLLAGSVARLYWEWQTQAALNTVLQQIEKEQNTIIATDRQLYQNGITSSVEGVETDINASKTRQQLNDVAGKMKIIEARLIALTNHQTKSLTLKPVALPKVASQLPDELGYSLLARRADLQAAHWYVESSLSTIDAAKAAFYPDINLMAFLQQDALHLSDLFRHSAQQMGVTAGLTLPIFDSGRLNANLDIAKAESNLSIASYNKAVVEAVNDVARAASQVQTLAEKNQHQAQIERDALRVVGLAQARFNAGIIAGSRVSEARIPALRERANGLLLQGQWLDASIQLTGALGGGYKR

SEQ ID NO: 19594 - protein, 567 aa, Escherichia coli O157:H7; identical to SEQ ID NO: 11409

SEQ ID NO: 19595 - protein, 167 aa, Escherichia coli O157:H7
MRSPKVKFLTIFTLSILITKMSFASSACFNEAGTMFRIEPNLIKAIALVESNLKKDSIGKNRDKKNNIKSFDYGLMQINQMHIPMLKKRGIIKDERDLLDNPCLNIKIGTEILYKHFSRCGMTWQCLGTYNAGFAMDNQKKRLQYAKKIYIVYTRLNELDNRKALAK

SEQ ID NO: 19596 - protein, 962 aa, Escherichia coli O157:H7
MPRSTWFKALLLLVALWAPLSQAETGWQPIQETIRKSDKDNRQYQAIRLDNGMVVLLVSDPQAVKSLSALVVPVGSLEDPEAYQGLAHYLEHMSLMGSKKYPQADSLAEYLKMHGGSHNASTAPYRTAFYLEVENDALPGAVDRLADAIAEPLLDKKYAERERNAVNAELTMARTRDGMRMAQVSAETINPAHPGSKFSGGNLETLSDKPGNPVQQALKDFHEKYYSANLMKAVIYSNKPLPELAKMAADTFGRVPNKESKKPEITVPVVTDAQKGIIIHYVPALPRKVLRVEFRIDNNSAKFRSKTDELITYLIGNRSPGTLSDWLQKQGLVEGISANSDPIVNGNSGVLAISASLTDKGLANRDQVVAAIFSYLNLLREKGIDKQYFDELANVLDIDFRYPSITRDMDYVEWLADTMIRVPVEHTLDAVNIADRYDAKAVKERLAMMTPQNARIWYISPKEPHNKTAYFVDAPYQVDKISEQTFADWQQKAANIALSLPELNPYIPDDFSLIKSEKKYDHPELIVDESNLRVVYAPSRYFSSEPKADVSLILRNPKAMDSARNQVMFALNDYLAGLALDQLSNQASVGGISFSTNANNGLMVNANGYTQRLPQLFQALLEGYFSYTATEDQLEQAKSWYNQMMDSAEKGKAFEQAIMPAQMLSQVPYFSRDERRKILPSITLKEVLAYRDALKSGARPEFMVIGNMTEAQATTLARDVQKQLGADGSEWCRNKDVVVDKKQSVIFEKAGNSTDSALAAVFVPTGYDEYTSSAYSSLLGQIVQPWFYNQLRTEEQLGYAVFAFPMSVGRQWGMGFLLQSNDKQPSFLWERYKAFFPTAEAKLRAMKPDEFAQIQQAVITQMLQAPQTLGEEALKLSKDFDRGNMRFDSRDKIVAQIKLLTPQKLADFFHQAVVEPQGMAILSQISGSQNGKAEYVHPEGWKVWENVSALQQTMPLMSEKNE

SEQ ID NO: 19597 - protein, 512 aa, Escherichia coli O157:H7
MARAVHRSGLVALGIATALMASCAFAAKDVVVAVGSNFTTLDPYDANDTLSQAVAKSFYQGLFGLDKEMKLKNVLAESYTVSDDGITYTVKLREGIKFQDGTDFNAAAVKANLDRASDPANHLKRYNLYKNIAKTEAIDPTTVKITLKQPFSAFINILAHPATAMISPAALEKYGKEIGFHPVGTGPYELDTWNQTDFVKVKKFAGYWQPGLPKLDSITWRPVADNNTRAAMLQTGEAQFAFPIPYEQAALLEKNKNIELMASPSIMQRYISMNVTQKPFDNPKVREALNYAINRPALVKVAFAGYATPATGVVPPSIAYAQSYKPWPYDPVKARELLKEAGYPNGFSTTLWSSHNHSTAQKVLQFTQQQLAQVGIKAQVTAMDAGQRAAEVEGKGQKESGVRMFYTGWSASTGEADWALSPLFASQNWPPTLFNTAFYSNKQVDDFLAQALKTNDPAEKTRLYKAAQDIIWQESPWIPLVVEKLVSAHSKNLTGFWIMPDTGFSFEDADLQ

SEQ ID NO: 19598 - protein, 614 aa, Escherichia coli O157:H7; identical to SEQ ID NO: 5715

SEQ ID NO: 19599 - protein, 102 aa, Escherichia coli O157:H7; identical to SEQ ID NO: 11707

SEQ ID NO: 19600 - protein, 826 aa, Escherichia coli O157:H7; identical to SEQ ID NO: 11397

SEQ ID NO: 19601 - protein, 351 aa, Escherichia coli O157:H7; identical to SEQ ID NO: 5767

SEQ ID NO: 19602 - protein, 760 aa, Escherichia coli O157:H7; identical to SEQ ID NO: 5756

SEQ ID NO: 19603 - protein, 332 aa, Escherichia coli O157:H7; identical to SEQ ID NO: 5757

SEQ ID NO: 19604 - protein, 412 aa, Escherichia coli O157:H7; identical to SEQ ID NO: 5719

SEQ ID NO: 19605 - protein, 230 aa, Escherichia coli O157:H7
MKNINAIILLSSLTSASVFAGAYVENREAYNLASDQGEVMLRVGYNFDMGAGIMLTNTYTFQREDELKHGYNEIEGWYPLFKPTDKLTIQPGGLINDKSIGSGGAVYLDVNYKFTPWFNLTVRNRFNHNNYSSTDLNGDLDNNDSYEIGNYWNFIITDKFSYTFEPHYFYNINDFNSGNGTKHHWEITNTFRYRINEHWLPYIELRWLDRNVEPYHREQNQIRIGTKYFF

SEQ ID NO: 19606 - protein, 729 aa, Escherichia coli O157:H7
  MOD_RES (35)..(35): Any amino acid
MLSTQFNRDNQYQAITKPSLLAGCIALALLPSAAXAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 19607 - protein, 719 aa, Escherichia coli O157:H7
  MOD_RES (702)..(702): Any amino acid
MRDEMLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHXTIPAAGFNAAIGFVWNF

SEQ ID NO: 19608 - protein, 266 aa, Escherichia coli O157:H7; identical to SEQ ID NO: 5771

SEQ ID NO: 19609 - protein, 747 aa, Escherichia coli O157:H7; identical to SEQ ID NO: 5774

SEQ ID NO: 19610 - protein, 243 aa, Escherichia coli O157:H7
MLMFPLVKKTVSALFVSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRPSGLQGEPAEAPAKITWKLNNAQLQANNPTPYYVSFNEVKLESGGKTYNVNSSMVTPFSQASFGVTSLPGSVSSGKVVFKAINDFGGNIDGSATF

SEQ ID NO: 19611 - protein, 516 aa, Escherichia coli O157:H7
MQRRDFLKYSVALGVASALPLWSRAVFAAERPTLPIPDLLTTDARNRIQLTIGAGQSTFGEKTATTWGYNGNLLGPAVKLQRGKAVTVDIYNQLTEETTLHWHGLEVPGEVDGGPQGIIPPGGKRSVTLNVDQPAATCWFHPHQHGKTGRQVAMGLAGLVVIEDDEILKLMLPKQWGIDDVPVIVQDKKFSADGQIDYQLDVMTAAVGWFGDTLLTNGAIYPQHAAPRGWLRLRLLNGCNARSLNFATSDNRPLYVIASDGGLLPEPVKVNELPVLMGERFEVLVEVNDNKPFDLVTLPVSQMGMAIAPFDKPHPVMRIQPIAISASGALPDTLSSLPALPSLEGLTVRKLQLSMDPMLDMMGMQMLMEKYGDQAMVGMDHSQMMGHMGHGNMNHMNHGGKFDFHHANKINGQAFDMNKPMFAAAKGQYERWVISGVGDMMLHPFHIHGTQFRILSENGKPPAAHRAGWKDTVKVEGNVSEVLVKFNHDAPKERAYMAHCHLLEHEDTGMMLGFTV

SEQ ID NO: 19612 - protein, 720 aa, Escherichia coli O157:H7; identical to SEQ ID NO: 11368

SEQ ID NO: 19613 - protein, 243 aa, Escherichia coli O157:H7; identical to SEQ ID NO: 11367

SEQ ID NO: 19614 - protein, 551 aa, Escherichia coli O157:H7; identical to SEQ ID NO: 5742

SEQ ID NO: 19615 - protein, 700 aa, Escherichia coli O157:H7
  MOD_RES (113)..(113): Any amino acid
  MOD_RES (265)..(265): Any amino acid
MKIVFVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPXTMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTKAEWKANPQQAXRAEQYDTRKTIKQTQAGLRYERSLSSRDDMSVMMYAGERETTQYQSIPMAPQLNPSHAGSVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGMEARYMGDIMADDENTAKAPSYTLVGLFTGYKYNYHNLTVDLFGRVDNLFDKEYVGSVIVNESNGRYYEPAPGRNYGVGVNIAWRFE

SEQ ID NO: 19616 - protein, 784 aa, Escherichia coli O157:H7; identical to SEQ ID NO: 5705

SEQ ID NO: 19617 - protein, 518 aa, Escherichia coli O157:H7; identical to SEQ ID NO: 11400

SEQ ID NO: 19618 - protein, 227 aa, Escherichia coli O157:H7; identical to SEQ ID NO: 11429

SEQ ID NO: 19619 - protein, 816 aa, Escherichia coli O157:H7; identical to SEQ ID NO: 11428

SEQ ID NO: 19620 - protein, 678 aa, Escherichia coli O157:H7; identical to SEQ ID NO: 5722

SEQ ID NO: 19621 - protein, 838 aa, Escherichia coli O157:H7; identical to SEQ ID NO: 5723

SEQ ID NO: 19622 - protein, 231 aa, Escherichia coli O157:H7; identical to SEQ ID NO: 5724

SEQ ID NO: 19623 - protein, 859 aa, Escherichia coli O157:H7
MWNLLRRTRKNQKSGRDVREVGWRSLFQAVAEPFAGAWQQGVKADPETVLSFHAVFSCISLISQDIAKMRLRLMQTDVQGIRREKRQGDTARLCRRPNAQQNRIQFFELWLNSKLRHGNTVVLKIRTPRGQIKELRILDWNRVEPLVADDGEVFYRITPDRNCGITESVTVPAREVIHDRFNCFFHPLVGLPPVYAAGLAAMQGHHIQANSTYFFRNGGRPSGVIEVPGSITEENAKKLKGNWDSGYTGENAGKTAILSNGAKYSPTTFSPVDAQTVEQLKMTAEIVCSVFRVPAYKIGVGHPPSSDNVEALEQQYYSQCLQTLIESIELLLDEALETGENESTEFDVTTLLRMDSERRMKTLGDAVKNTLLTPNEARKRENLPPLAGGDALYLQQQNYSLEALSRRDAREDPFASAGKTVSSQLPDGASDGNKAISETEHDAVKAMFRGDTEKMTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 19624 - protein, 240 aa, Escherichia coli O157:H7
MDMEKIRMNIFAYLLVLVFSMSMSSSAFASVVMTGTRIIFPGDAKEKTIQLRNTSDQPYIINIHVEDERGSDKNVPFMPTPQTFRMEAAAGQALRLLYTGNNLPQDRESVFWFSFSQLPYLNKNDKSQNQLILALTNRVKIFYRPSSIVGKSSDAPKNLTYQVKQNRIEVTNPTGYYVTIRAAELLNNGKKVPLANSVMIAPQSTTEWTLPSGISVAPGAQIHLVTVNDYGVNVTSEHAL

SEQ ID NO: 19625 - protein, 840 aa, Escherichia coli O157:H7
  MOD_RES (811)..(811): Any amino acid
MNKSVVSISAAMLVLLCQPVMGSEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAKELAPGITSQTQLSQLRLDLSVPQSQLISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTTVGLNASKGQDYWQASGNVQGAMAVHGGGITFGPYLGETFALVEAKGAEGAKVYNSSQLEINDSGYALVPAVTPYRYNRISLDPQGMDGDAELVDSERQVAPVAGAAVKVIFRTRPGKALLIKSRMADGSELPMGADVLDENNTVVGIAGQGGQIYLRTEQTKGHLSVRWGEXANDSCQLPFDISGKDSNSPIIRLNETCQS

SEQ ID NO: 19626 - protein, 672 aa, Escherichia coli O157:H7
MLRNGNKYLLMLVSIIMLTACISQSRTSFIPPQDRKSLLAEQPWPHNGFVAISWHNVEDEAADQRFMSVRTSALREQFAWLRENGYQPVSIAQIREAHRGGKPLPEKAVVLTFDDGYQSFYTRVFPILQAFQWPAVWAPVGSWVDTPADKQVKFGDELVDREYFATWQQVREVARSRLVELASHTWNSHYGIQANATGSLLPVYVNRAYFTDHARYETAAEYRERIRLDAVKMTEYLRTKVEVNPHVFIWPYGEANGIAIEELKKLGYDMFFTLESGLANASQLDSIPRVLIANNPSLKEFAQQIITVQEKSPQRIMHIDLDYVYDENLQQMDRNIDVLIQRVKDMQISTVYLQAFADPDGDGLVKEVWFPNRLLPMKADIFSRVAWQLRTRSGVNIYAWMPVLSWDLDPTLTRVKYLPTGEKKAQIHPEQYHRLSPFDDRVRAQVGMLYEDLAGHAAFDGILFHDDALLSDYEDASAPAITAYQQAGFSGSLSEIRQNPEQFKQWARFKSRALTDFTLELSARVKAIRGPHIKTARNIFALPVIQPESEAWFAQNYADFLKSYDWTAIMAMPYLEGVAEKSADQWLIQLTNQIKNIPQAKDKSILELQAQNWQKNGQHQAISSQQLAHWMSLLQLNGVKNYGYYPDNFLHNQPEIDLIRPEFSTAWYPKND

SEQ ID NO: 19627 - protein, 366 aa, Escherichia coli O157:H7; identical to SEQ ID NO: 11362

SEQ ID NO: 19628 - protein, 423 aa, Escherichia coli O157:H7
MQYEDKNGVNEPSRRRLLKGIGALALAGSCPVAHAQKTQSAPGTLSPVARNEKQPFYGEHQAGILTPQQAAMMLVAFDVLASDKADLERLFRLLTQRFAFLTQGGAAPETPNPRLPPLDSGILGGYIAPDNLTITLSVGHSLFDERFGLAPQMPKKLQKMTRFPNDSLDAALCHGDVLLQICANTQDTVIHALRDIIKHTPDLLSVRWKREGFISDHAARSKGKETPINLLGFKDGTANPDSQNDKLMQKVVWVTADQQEPAWTIGGSYQAVRLIQFRVEFWDRTPLKEQQTIFGRDKQTGAPLGMQHEHDVPDYASDPEGKGIALDSHIRLANPRTAESESSLMLRRGYSYSLGVTNSGQLDMGLLFVCYQHDLEKGFLTVQKRLNGEALEEYVKPIGGGYFFALPGVKDANDYLGSALLRV

SEQ ID NO: 19629 - protein, 375 aa, Escherichia coli O157:H7
MTINFRRNALQLSVAALFSSAFMANAADVPQVKVTVTDKQCEPMTITVNAGKTQFIIQNHSQKALEWEILKGVMVVEERENIAPGFSQKMTANLQPGEYDMTCGLLTNPKGKLIVKGEATADAAQSDALLSLGGAITAYKAYVMAETTQLVTDTKAFTDAIKAGDIEKAKALYAPTRQHYERIEPIAELFSDLDGSIDAREDDYEQKAADPKFTGFHRLEKALFGDNTTKGMDQYADQLYTDVVDLQKRISELAFPPSKVVGGAAGLIEEVAASKISGEEDRYSHTDLWDFQANVEGSQKIVDLLRPQLQKANPELLAKVDANFKKVDTILAKYRTKDGFETYDKLTDADRNALKGPITALAEDLAQLRGVLGLD

SEQ ID NO: 19630 - protein, 883 aa, Escherichia coli O157:H7; identical to SEQ ID NO: 5702

SEQ ID NO: 19631 - protein, 239 aa, Escherichia coli O157:H7; identical to SEQ ID NO: 12299

SEQ ID NO: 19632 - protein, 340 aa, Escherichia coli O157:H7; identical to SEQ ID NO: 7429

SEQ ID NO: 19633 - protein, 127 aa, Escherichia coli O157:H7
MPMYLLRLFFAVTLITQMSMATAGIVVGGTRVIFYGDKPDTTISIFNKETNLPYLLQTWVDPFNKEDKSKPPFSVIPPVSRIEPQQEKILRILKTAGELPKDRESVFWLNVKNIPPSIDKKIPMFLR

SEQ ID NO: 19634 - protein, 334 aa, Escherichia coli O157:H7
MKKNQFLKESDVTAESVFFMKRRQVLKALGISAAALSLPHAAHADLLSWFKGNDRPPAPAGKALEFSKPAAWQNNLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILDVQRQPTLLFNGYADQVASLYRGLDLRENF

SEQ ID NO: 19635 - protein, 137 aa, Escherichia coli O157:H7
MLKRYLVLSVVTAAFSLPSLVYAAQQNILSVHILNQQTGKPAADVTVTLEKKADNGWLQLNTAKTDKDGRIKALWPEQTATTGDYRVVFKTGDYFKKQNLESFFPEIPVEFHINKVNEHYHVPLLLSQYGYSTYRGS

SEQ ID NO: 19636 - protein, 191 aa, Escherichia coli O157:H7
  MOD_RES (109)..(109): Any amino acid
MSTSYDFDFGLSLGAAYSNSDRTDNQVHKGTHNTRYGDRFDATAGGETAEAWTVGAKYDANNVYLAAMYAEPRNMTGYGDADAIANKTQNFEVVAQYQFDFGLRPSIAXLQSKGKDLGGVNSDNFDSQGNHHYTNKDLVKYVDIGMTYYFNKNMSTYVDYKINLLDNDDDFYKENGIATDDIVAVGLVYQF

SEQ ID NO: 19637 - protein, 193 aa, Escherichia coli O157:H7; identical to SEQ ID NO: 5760

SEQ ID NO: 19638 - protein, 713 aa, Escherichia coli O157:H7; identical to SEQ ID NO: 11411

SEQ ID NO: 19639 - protein, 186 aa, Escherichia coli O157:H7
MNVSKYVAIFSFVFIQLISVGKVFANADEWMTTFRENIVQTWQQPEHYDLYIPAITWHARFAYDKEKTDRYNERPWGGGFGLSRWDEKGNWHGLYAMAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 19640 - protein, 746 aa, Escherichia coli O157:H7; identical to SEQ ID NO: 5761

SEQ ID NO: 19641 - protein, 110 aa, Escherichia coli O157:H7
MKKALQVAMFSLFTVIGFNAQANEHHHETMSEAQPQVISATGVVKGFDLESKKITIHHDPIAAVNWPEMTMRFTITPQTKMSGIKTGDKVAFNFVQQGNLSLLQDIKVSQ

SEQ ID NO: 19642 - protein, 460 aa, Escherichia coli O157:H7
MSPCKLLPFCVALALTGCSLAPDYQRPAMPVPQQFSLSQNGLVNAADNYQNAGWRTFFVDNQVKTLISEALENNRDLRMATLKVQEARAQYRLTDADRYPQLNGEGSGSWSGNLKGDSATTREFSTGLNASFDLDFFGRLKNMSEAERQNYLATEEAQRAVHILLVSNVAQSYFNQQLAYAQLQIAEETLRNYQQSYAFVEKQLLTGSSNVLALEQARGVIESTRSDIAKRQGELAQANNALQLLLGSYGKLPQAQTVNSDSLQSVKLPAGLSSQILLQRPDIMEAEHALMAANANIGAARAAFFPSISLTSGISTASSDLSSLFNASSGMWNFIPKIEIPIFNAGRNQANLDIAEIRQQQSVVNYEQKIQNAFKEVADALALRQSLNDQISAQQRYLASLQITLQRARALYQHGAVSYLEVLDAERSLFATRQTVLDLNYARQVNEISLYTALGGGWQQ

SEQ ID NO: 19643 - protein, 878 aa, Escherichia coli O157:H7
  MOD_RES (647)..(647): Any amino acid
MSYLNLRLYQRNTQCLHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLARNVNIPFSHWLRSDSKSQWRHASASYSMSHDLNGRMTNLAGVYGTLLEDNNXSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 19644 - protein, 118 aa, Escherichia coli O157:H7 [sequence omitted]

SEQ ID NO: 19645 - protein, 446 aa, Escherichia coli O157:H7
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGKTPQGQALAATANGIDSNTKIAHLNGNQWGFGWNAGILYELDKNNRYALTYRSEVKIDFKGNYSSDLNRVFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 19646 - protein, 879 aa, Escherichia coli O157:H7
  MOD_RES (5)..(5): Any amino acid
  MOD_RES (205)..(205): Any amino acid
  MOD_RES (582)..(582): Any amino acid
MPDHXLFRLRVLPCCVALAMSGSYVNAWAENEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNXGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDITHSHTRLDKETAYGKGSLDGNSFRLSYSKDFDELNSRVTFAGYRFSEENFMTMSEYLDASDSEMVRTGNDKEMYTATYNQNFRDAGVSVYLNYTRHTYWDRDEQTNYNVMLSHYFNLGSIRNMSISMTGYRYEYDNQADKGVYISLXMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQGTLTEGAIGYRKFSVISGQKAMAVLRLQDGSYPPFGAEVKNDSAQNVGLVDDDGNVYLAGVKPGEHMIVSWGGVAHCDIHLPDPLPADLFNGLLLPCQQTGAISPSMPHEIKPVIQEQTQQVMPTEAPVSVSAN

SEQ ID NO: 19647 - protein, 252 aa, Escherichia coli O157:H7; identical to SEQ ID NO: 11406

SEQ ID NO: 19648 - protein, 274 aa, Escherichia coli O157:H7; identical to SEQ ID NO: 5731

SEQ ID NO: 19649 - protein, 359 aa, Escherichia coli O157:H7; identical to SEQ ID NO: 11410

SEQ ID NO: 19650 - protein, 869 aa, Escherichia coli O157:H7
  MOD_RES (681)..(681): Any amino acid
MKIPTTTDIPQRYTWCLAGICYSSLAILPSFLSYAESYFNPAFLLENGTFVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVXWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 19651 - protein, 230 aa, Escherichia coli O157:H7; identical to SEQ ID NO: 5765

SEQ ID NO: 19652 - protein, 658 aa, Escherichia coli O157:H7
MSDDMSMGLPSSAGEHGVLRSMQEVAMSSQEASKMLRTYNIAWWGNNYYDVNELGHISVCPDPDVPEARVDLAQLVKTREAQGQRLPALFCFPQILQHRLRSINAAFKRARESYGYNGDYFLVYPIKVNQHRRVIESLIHSGEPLGLEAGSKAELMAVLAHAGMTRSVIVCNGYKDREYIRLALIGEKMGHKVYLVIEKMSEIAIVLDEAERLNVVPRLGVRARLASQGSGKWQSSGGEKSKFGLAATQVLQLVETLREAGRLDSLQLLHFHLGSQMANIRDIATGVRESARFYVELHKLGVNIQCFDVGGGLGVDYEGTRSQSDCSVNYGLNEYANNIIWAIGDACEENGLPHPTVITESGRAVTAHHTVLVSNIIGVERNEYTVPTAPAEDAPRALQSMWETWQEMHEPGTRRSLREWLHDSQMDLHDIHIGYSSGTFSLQERAWAEQLYLSMCHEVQKQLDPQNRAHRPIIDELQERMADKMYVNFSLFQSMPDAWGIDQLFPVLPLEGLDQVPERRAVLLDITCDSDGAIDHYIDGDGIATTMPMPEYDPENPPMLGFFMVGAYQEILGNMHNLFGDTEAVDVFVFPDGSVEVELSDEGDTVADMLQYVQLDPKTLLTQFRDQVKKTDLDAELQQQFLEEFEAGLYGYTYLEDE

SEQ ID NO: 19653 - protein, 189 aa, Escherichia coli O157:H7; identical to SEQ ID NO: 5703

SEQ ID NO: 19654 - protein, 866 aa, Escherichia coli O157:H7
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACAPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDIYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLSEYGSFYLSGSQQTYWHTDQQDRLLQFGYNTQIKDLSLGISWNYSKSRGQPDADQVFALNFSLPLNLLLSRSNDSYTSKKNYAWMTSNTSIDNEGHTTQNLGLTETLLDDGNLSYSVQQGYNSEGKTANGSASMDYKGVFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGISLRFGAIATLDGVQTNSGIIDDDGSLYMAGLPAKGTITVRWGEAPDQICHISYELTEQQINSAITRMDAICR

SEQ ID NO: 19655 - protein, 362 aa, Escherichia coli O157:H7; identical to SEQ ID NO: 5754

SEQ ID NO: 19656 - protein, 561 aa, Escherichia coli O157:H7
MKSPAPSRPQKMALIPACIFLCFAALSVQAEETPVTPQPPDILLGPLFNDVQNAKLFPDQKTFADAVPNSDPLMIRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPVKQKEAEPTP

SEQ ID NO: 19657 - protein, 656 aa, Escherichia coli O157:H7
  MOD_RES (87)..(87): Any amino acid
MRLKKHYLCTALSLAFTQQAVAAQESDSLTVWSSPVSSTTTTVLDQPTMKALDKQNVAQALSVVPGVVLQKSGSRNEEQVKVRGFDXRQVPVYFDGVPIYVPYDGNLDLARILTNNLGAVEVSKGYSSLLQGPNQMGGAINITTQKPTKPLEASLGYRQGWSRSQDNAYDMHASFAASSELGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLTFAVNWKDDVHREKGAPHAAYDRYEDRTWSLASEYQWAAADNVDVVAGISYDWRDSVEAKKHEKDGSITHYDDNNQSAFNWQVMGKYHFVNEDTLALSYYDRKRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFVEEGRNFWAGVEYTF

SEQ ID NO: 19658 - protein, 203 aa, Escherichia coli O157:H7; identical to SEQ ID NO: 6347

SEQ ID NO: 19659 - protein, 200 aa, Escherichia coli O157:H7; identical to SEQ ID NO: 5732

SEQ ID NO: 19660 - protein, 367 aa, Escherichia coli O157:H7; identical to SEQ ID NO: 5700

SEQ ID NO: 19661 - protein, 162 aa, Escherichia coli O157:H7; identical to SEQ ID NO: 5734

SEQ ID NO: 19662 - protein, 828 aa, Escherichia coli O157:H7; identical to SEQ ID NO: 5735

SEQ ID NO: 19663 - protein, 83 aa, Escherichia coli O157:H7; identical to SEQ ID NO: 6252

SEQ ID NO: 19664 - protein, 83 aa, Escherichia coli O157:H7
  MOD_RES (13)..(13): Any amino acid
  MOD_RES (43)..(43): Any amino acid
MKKMFMAVLFALXSVNAMAADCAKGKIEFSKYNEBDTFTVKVXGKEYWTSRWNLQPLLQSAQLTGMTVTIKSSTCESGSGFAE

SEQ ID NO: 19665 - protein, 696 aa, Escherichia coli O157:H7; identical to SEQ ID NO: 6320

SEQ ID NO: 19666 - protein, 303 aa, Escherichia coli O157:H7
MTEIVADKTVEVVKNAIETADGALDLYNKYLDQVIPWQTFDETIKELSRFKQEYSQAASVLVGNIKTLLMDSQDKYFEATQTVYEWCGVATQLLAAYILLFDEYNEKKASAQKDILIKVLDDGITKLNEAQKSLLVSSQSFNNASGKLLALDSQLTNDFSEKSSYFQSQVDKIRKEAYAGAAAGVVAGPFGLIISYSIAAGVVEGKLIPELKNKLKSVQSFFTTLSNTVKQANKDIDAAKLKLTTEIAAIGEIKTETETTRFYVDYDDLMLSLLKEAANKMINTCNEYQKRHGKKTLFEVPEV

SEQ ID NO: 19667 - protein, 642 aa, Escherichia coli O157:H7
MFTTVILGAIPGWGAEFSANFKDTDIQEFINTVSKNLHKTVIINPDVQGTITVRSYDMLNEEQYYQFFLSVLDVYGFAVVDMHNGILKVVRSKDAKTSAVPVASDVSPGTGDEVVTRVVPVSNVAARDLAPLLRQLNDNAGAGSVVHYEPSNVLLMTGRAAVMKRLMEIVERVDKVGNRSVATVPLTYASATDVARLVTELTKETDKTAIPAWMTAKLVADERTNSVLVSGEPISQQRIISIIKQLDRQEDVQGNTKVIYLKYAKAKDLVEVLTGISSSIENDSKKSPSTEALRKGVTIKSHEQTNALILTGAPDVIRDLENVISQLDIRRPQVLVEAIIAEIQDADGLNLGIQWVNKHAGVAQFTSTGLPITTMVQTRQNEILDSDQSNALSMFNGIAAGFYQGNWAMLLTALSTSSKNDILATPSIVTLDNMEATFNVGQEVPVLSGSQTTSGDNIFNTVERKTVGIKLRVKPQINEGDSVLLEIEQEVSGVADTAVATTTDLGATFNTRTVTNAMLVGNGETVVVGGLLDKSIRGSESKVPLLGDIPVLGHLFRAKSEQTAKRNLMLFIRPTIIRERDGFRHASAEKYQSFNQEQVQSRGKETTALTLNEEQLRLSPDQDDTAFRKVKAAIAAFYAQEM

SEQ ID NO: 19668 - protein, 998 aa, Escherichia coli O157:H7; identical to SEQ ID NO: 5657
  strain EC4115 / EHEC

SEQ ID NO: 19669 - protein, 655 aa, Escherichia coli O157:H7; identical to SEQ ID NO: 11466
  strain EC4115 / EHEC

SEQ ID NO: 19670 - protein, 230 aa, Escherichia coli O157:H7; identical to SEQ ID NO: 5765
  strain EC4115 / EHEC

SEQ ID NO: 19671 - protein, 869 aa, Escherichia coli O157:H7; identical to SEQ ID NO: 5763
  strain EC4115 / EHEC

SEQ ID NO: 19672 - protein, 746 aa, Escherichia coli O157:H7; identical to SEQ ID NO: 5761
  strain EC4115 / EHEC

SEQ ID NO: 19673 - protein, 359 aa, Escherichia coli O157:H7; identical to SEQ ID NO: 11410
  strain EC4115 / EHEC

SEQ ID NO: 19674 - protein, 193 aa, Escherichia coli O157:H7; identical to SEQ ID NO: 5760
  strain EC4115 / EHEC

SEQ ID NO: 19675 - protein, 243 aa, Escherichia coli O157:H7; identical to SEQ ID NO: 11367
  strain EC4115 / EHEC

SEQ ID NO: 19676 - protein, 816 aa, Escherichia coli O157:H7; identical to SEQ ID NO: 11682
  strain EC4115 / EHEC

SEQ ID NO: 19677 - protein, 122 aa, Escherichia coli O157:H7; identical to SEQ ID NO: 5737
  strain EC4115 / EHEC

SEQ ID NO: 19678 - protein, 713 aa, Escherichia coli O157:H7; identical to SEQ ID NO: 11726
  strain EC4115 / EHEC

SEQ ID NO: 19679 - protein, 430 aa, Escherichia coli O157:H7; identical to SEQ ID NO: 5758
  strain EC4115 / EHEC

SEQ ID NO: 19680 - protein, 224 aa, Escherichia coli O157:H7; identical to SEQ ID NO: 11649
  strain EC4115 / EHEC

SEQ ID NO: 19681 - protein, 863 aa, Escherichia coli O157:H7
  strain EC4115 / EHEC
MIMAAVPGQKLVHCNNKYKNTGHQGMPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYNFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 19682 - protein, 678 aa, Escherichia coli O157:H7; identical to SEQ ID NO: 5722
  strain EC4115 / EHEC

SEQ ID NO: 19683 - protein, 331 aa, Escherichia coli O157:H7; identical to SEQ ID NO: 6551
  strain EC4115 / EHEC

SEQ ID NO: 19684 - protein, 760 aa, Escherichia coli O157:H7; identical to SEQ ID NO: 5756
  strain EC4115 / EHEC

SEQ ID NO: 19685 - protein, 334 aa, Escherichia coli O157:H7; identical to SEQ ID NO: 19634
  strain EC4115 / EHEC

SEQ ID NO: 19686 - protein, 203 aa, Escherichia coli O157:H7; identical to SEQ ID NO: 6414
  strain EC4115 / EHEC

SEQ ID NO: 19687 - protein, 362 aa, Escherichia coli O157:H7; identical to SEQ ID NO: 5754
  strain EC4115 / EHEC

SEQ ID NO: 19688 - protein, 224 aa, Escherichia coli O157:H7; identical to SEQ ID NO: 11374
  strain EC4115 / EHEC

SEQ ID NO: 19689 - protein, 715 aa, Escherichia coli O157:H7; identical to SEQ ID NO: 11710
  strain EC4115 / EHEC

SEQ ID NO: 19690 - protein, 89 aa, Escherichia coli O157:H7; identical to SEQ ID NO: 6053
  strain EC4115 / EHEC

SEQ ID NO: 19691 - protein, 412 aa, Escherichia coli O157:H7; identical to SEQ ID NO: 5719
  strain EC4115 / EHEC

SEQ ID NO: 19692 - protein, 229 aa, Escherichia coli O157:H7; identical to SEQ ID NO: 11455
  strain EC4115 / EHEC

SEQ ID NO: 19693 - protein, 233 aa, Escherichia coli O157:H7; identical to SEQ ID NO: 11381
  strain EC4115 / EHEC

SEQ ID NO: 19694 - protein, 696 aa, Escherichia coli O157:H7; identical to SEQ ID NO: 6320
  strain EC4115 / EHEC

SEQ ID NO: 19695 - protein, 826 aa, Escherichia coli O157:H7; identical to SEQ ID NO: 11397
  strain EC4115 / EHEC

SEQ ID NO: 19696 - protein, 224 aa, Escherichia coli O157:H7; identical to SEQ ID NO: 11398
  strain EC4115 / EHEC

SEQ ID NO: 19697 - protein, 660 aa, Escherichia coli O157:H7; identical to SEQ ID NO: 11731
  strain EC4115 / EHEC

SEQ ID NO: 19698 - protein, 229 aa, Escherichia coli O157:H7; identical to SEQ ID NO: 11418
  strain EC4115 / EHEC

SEQ ID NO: 19699 - protein, 517 aa, Escherichia coli O157:H7; identical to SEQ ID NO: 6817
  strain EC4115 / EHEC

SEQ ID NO: 19700 - protein, 191 aa, Escherichia coli O157:H7; identical to SEQ ID NO: 5748
  strain EC4115 / EHEC

SEQ ID NO: 19701 - protein, 232 aa, Escherichia coli O157:H7; identical to SEQ ID NO: 5747
  strain EC4115 / EHEC

SEQ ID NO: 19702 - protein, 365 aa, Escherichia coli O157:H7; identical to SEQ ID NO: 19529
  strain EC4115 / EHEC

SEQ ID NO: 19703 - protein, 729 aa, Escherichia coli O157:H7; identical to SEQ ID NO: 5745
  strain EC4115 / EHEC

SEQ ID NO: 19704 - protein, 213 aa, Escherichia coli O157:H7; identical to SEQ ID NO: 5744
  strain EC4115 / EHEC

SEQ ID NO: 19705 - protein, 558 aa, Escherichia coli O157:H7; identical to SEQ ID NO: 5974
  strain EC4115 / EHEC

SEQ ID NO: 19706 - protein, 659 aa, Escherichia coli O157:H7; identical to SEQ ID NO: 5736
  strain EC4115 / EHEC

SEQ ID NO: 19707 - protein, 828 aa, Escherichia coli O157:H7; identical to SEQ ID NO: 5735
  strain EC4115 / EHEC

SEQ ID NO: 19708 - protein, 162 aa, Escherichia coli O157:H7; identical to SEQ ID NO: 5734
  strain EC4115 / EHEC

SEQ ID NO: 19709 - protein, 367 aa, Escherichia coli O157:H7; identical to SEQ ID NO: 5700
  strain EC4115 / EHEC

SEQ ID NO: 19710 - protein, 200 aa, Escherichia coli O157:H7; identical to SEQ ID NO: 5733
  strain EC4115 / EHEC

SEQ ID NO: 19711 - protein, 512 aa, Escherichia coli O157:H7; identical to SEQ ID NO: 5948
  strain EC4115 / EHEC

SEQ ID NO: 19712 - protein, 203 aa, Escherichia coli O157:H7; identical to SEQ ID NO: 6347
  strain EC4115 / EHEC

SEQ ID NO: 19713 - protein, 207 aa, Escherichia coli O157:H7; identical to SEQ ID NO: 5743
  strain EC4115 / EHEC

SEQ ID NO: 19714 - protein, 274 aa, Escherichia coli O157:H7; identical to SEQ ID NO: 5731
  strain EC4115 / EHEC

SEQ ID NO: 19715 - protein, 252 aa, Escherichia coli O157:H7; identical to SEQ ID NO: 11406
  strain EC4115 / EHEC

SEQ ID NO: 19716 - protein, 860 aa, Escherichia coli O157:H7; identical to SEQ ID NO: 11720
  strain EC4115 / EHEC

SEQ ID NO: 19717 - protein, 227 aa, Escherichia coli O157:H7; identical to SEQ ID NO: 11429
  strain EC4115 / EHEC

SEQ ID NO: 19718 - protein, 89 aa, Escherichia coli O157:H7; identical to SEQ ID NO: 6233
  strain EC4115 / EHEC

SEQ ID NO: 19719 - protein, 208 aa, Escherichia coli O157:H7; identical to SEQ ID NO: 5717
  strain EC4115 / EHEC

SEQ ID NO: 19720 - protein, 241 aa, Escherichia coli O157:H7; identical to SEQ ID NO: 11431
  strain EC4115 / EHEC

SEQ ID NO: 19721 - protein, 614 aa, Escherichia coli O157:H7; identical to SEQ ID NO: 5715
  strain EC4115 / EHEC

SEQ ID NO: 19722 - protein, 747 aa, Escherichia coli O157:H7; identical to SEQ ID NO: 5775
  strain EC4115 / EHEC

SEQ ID NO: 19723 - protein, 266 aa, Escherichia coli O157:H7; identical to SEQ ID NO: 5771
  strain EC4115 / EHEC

SEQ ID NO: 19724 - protein, 810 aa, Escherichia coli O157:H7; identical to SEQ ID NO: 6345
  strain EC4115 / EHEC

SEQ ID NO: 19725 - protein, 161 aa, Escherichia coli O157:H7; identical to SEQ ID NO: 5769
  strain EC4115 / EHEC

SEQ ID NO: 19726 - protein, 539 aa, Escherichia coli O157:H7; identical to SEQ ID NO: 6525
  strain EC4115 / EHEC

SEQ ID NO: 19727 - protein, 700 aa, Escherichia coli O157:H7; identical to SEQ ID NO: 5740
  strain EC4115 / EHEC

SEQ ID NO: 19728 - protein, 518 aa, Escherichia coli O157:H7; identical to SEQ ID NO: 11400
  strain EC4115 / EHEC

SEQ ID NO: 19729 - protein, 446 aa, Escherichia coli O157:H7; identical to SEQ ID NO: 5714
  strain EC4115 / EHEC

SEQ ID NO: 19730 - protein, 237 aa, Escherichia coli O157:H7; identical to SEQ ID NO: 5713
  strain EC4115 / EHEC

SEQ ID NO: 19731 - protein, 478 aa, Escherichia coli O157:H7; identical to SEQ ID NO: 5712
  strain EC4115 / EHEC

SEQ ID NO: 19732 - protein, 351 aa, Escherichia coli O157:H7; identical to SEQ ID NO: 5767
  strain EC4115 / EHEC

SEQ ID NO: 19733 - protein, 366 aa, Escherichia coli O157:H7; identical to SEQ ID NO: 11362
  strain EC4115 / EHEC

SEQ ID NO: 19734 - protein, 740 aa, Escherichia coli O157:H7
  strain EC4115 / EHEC
MVDASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPRFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGATFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSTLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 19735 - protein, 236 aa, Escherichia coli O157:H7; identical to SEQ ID NO: 11364
  strain EC4115 / EHEC

SEQ ID NO: 19736 - protein, 859 aa, Escherichia coli O157:H7
  strain EC4115 / EHEC
MWNLLRRTRKNQKSGRDVREAGWTSLFQAVAEPFSGAWQQGVKADPEAVLSFHAVFACISLISQDIAKMRLRLMQTDAHGIRRETRRGDIARLCRRPNAQQNRIQFFELWLNAKLRHGNTVVLKIRNARGQIKELRILDWSRVEPLVADDGEVFYRITPDRNCGITEAVTVPAREVIHDRFNCFFHPLIGLPPVYAAGLAATQGHHIQENSTSFFRNGGRPSGVIEIPGSITEENAKKLKSNWDSGYTGENAGKTAILSNGAKYNPTTFSPVDAQTVEQLKMTAEIVCSVFRVPAYKIGVGQPPSSDNVEALEQQYYSQCLQTLIESIELLLDEALETGENESTEFDVTTLLRMDSERRMKTLGDAVKNTLLTPNEARKRENLPPLAGGDALYLQQQNYSLEALSRRDAREDPFASAGKTVSSQLPDGASDGNKAISETEHDAVKAMFRGDTEKMTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 19737 - protein, 432 aa, Escherichia coli O157:H7; identical to SEQ ID NO: 5727
  strain EC4115 / EHEC

SEQ ID NO: 19738 - protein, 368 aa, Escherichia coli O157:H7; identical to SEQ ID NO: 11425
  strain EC4115 / EHEC

SEQ ID NO: 19739 - protein, 241 aa, Escherichia coli O157:H7; identical to SEQ ID NO: 5709
  strain EC4115 / EHEC

SEQ ID NO: 19740 - protein, 878 aa, Escherichia coli O157:H7; identical to SEQ ID NO: 5707
  strain EC4115 / EHEC

SEQ ID NO: 19741 - protein, 111 aa, Escherichia coli O157:H7; identical to SEQ ID NO: 5738
  strain EC4115 / EHEC

SEQ ID NO: 19742 - protein, 567 aa, Escherichia coli O157:H7; identical to SEQ ID NO: 11409
  strain EC4115 / EHEC

SEQ ID NO: 19743 - protein, 203 aa, Escherichia coli O157:H7; identical to SEQ ID NO: 6414
  strain TW14359 / EHEC

SEQ ID NO: 19744 - protein, 362 aa, Escherichia coli O157:H7; identical to SEQ ID NO: 5754
  strain TW14359 / EHEC

SEQ ID NO: 19745 - protein, 233 aa, Escherichia coli O157:H7; identical to SEQ ID NO: 5752
  strain TW14359 / EHEC

SEQ ID NO: 19746 - protein, 180 aa, Escherichia coli O157:H7
  strain TW14359 / EHEC
MTNTWNRLALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGCRATRWKLINNYAGHGSRRVYNSLTQRLITLT

SEQ ID NO: 19747 - protein, 274 aa, Escherichia coli O157:H7; identical to SEQ ID NO: 5731
  strain TW14359 / EHEC

SEQ ID NO: 19748 - protein, 252 aa, Escherichia coli O157:H7; identical to SEQ ID NO: 11406
  strain TW14359 / EHEC

SEQ ID NO: 19749 - protein, 879 aa, Escherichia coli O157:H7; identical to SEQ ID NO: 19287
  strain TW14359 / EHEC

SEQ ID NO: 19750 - protein, 89 aa, Escherichia coli O157:H7; identical to SEQ ID NO: 6233
  strain TW14359 / EHEC

SEQ ID NO: 19751 - protein, 368 aa, Escherichia coli O157:H7; identical to SEQ ID NO: 11425
  strain TW14359 / EHEC

SEQ ID NO: 19752 - protein, 241 aa, Escherichia coli O157:H7; identical to SEQ ID NO: 5709
  strain TW14359 / EHEC

SEQ ID NO: 19753 - protein, 878 aa, Escherichia coli O157:H7; identical to SEQ ID NO: 5707
  strain TW14359 / EHEC

SEQ ID NO: 19754 - protein, 229 aa, Escherichia coli O157:H7; identical to SEQ ID NO: 11455
  strain TW14359 / EHEC

SEQ ID NO: 19755 - protein, 551 aa, Escherichia coli O157:H7
  strain TW14359 / EHEC
MNKSVVSISAAMLVLLCQPVMGSEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAKELAPGITSQTQLSQLRLDLSVPQSQLISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNRRTPKNGRL

SEQ ID NO: 19756 - protein, 233 aa, Escherichia coli O157:H7; identical to SEQ ID NO: 11381
  strain TW14359 / EHEC

SEQ ID NO: 19757 - protein, 696 aa, Escherichia coli O157:H7; identical to SEQ ID NO: 6320
  strain TW14359 / EHEC

SEQ ID NO: 19758 - protein, 511 aa, Escherichia coli O157:H7; identical to SEQ ID NO: 5749
  strain TW14359 / EHEC

SEQ ID NO: 19759 - protein, 191 aa, Escherichia coli O157:H7; identical to SEQ ID NO: 5748
  strain TW14359 / EHEC

SEQ ID NO: 19760 - protein, 518 aa, Escherichia coli O157:H7; identical to SEQ ID NO: 11400
  strain TW14359 / EHEC

SEQ ID NO: 19761 - protein, 232 aa, Escherichia coli O157:H7; identical to SEQ ID NO: 5747
  strain TW14359 / EHEC

SEQ ID NO: 19762 - protein, 365 aa, Escherichia coli O157:H7; identical to SEQ ID NO: 19529
  strain TW14359 / EHEC

SEQ ID NO: 19763 - protein, 729 aa, Escherichia coli O157:H7; identical to SEQ ID NO: 5745
  strain TW14359 / EHEC

SEQ ID NO: 19764 - protein, 213 aa, Escherichia coli O157:H7; identical to SEQ ID NO: 5744
  strain TW14359 / EHEC

SEQ ID NO: 19765 - protein, 203 aa, Escherichia coli O157:H7; identical to SEQ ID NO: 6347
  strain TW14359 / EHEC

SEQ ID NO: 19766 - protein, 207 aa, Escherichia coli O157:H7; identical to SEQ ID NO: 5743
  strain TW14359 / EHEC

SEQ ID NO: 19767 - protein, 432 aa, Escherichia coli O157:H7; identical to SEQ ID NO: 5727
  strain TW14359 / EHEC

SEQ ID NO: 19768 - protein, 567 aa, Escherichia coli O157:H7; identical to SEQ ID NO: 11409
  strain TW14359 / EHEC

SEQ ID NO: 19769 - protein, 359 aa, Escherichia coli O157:H7; identical to SEQ ID NO: 11410
  strain TW14359 / EHEC

SEQ ID NO: 19770 - protein, 551 aa, Escherichia coli O157:H7; identical to SEQ ID NO: 5742
  strain TW14359 / EHEC

SEQ ID NO: 19771 - protein, 713 aa, Escherichia coli O157:H7; identical to SEQ ID NO: 11726
  strain TW14359 / EHEC

SEQ ID NO: 19772 - protein, 700 aa, Escherichia coli O157:H7; identical to SEQ ID NO: 5740
  strain TW14359 / EHEC

SEQ ID NO: 19773 - protein, 366 aa, Escherichia coli O157:H7; identical to SEQ ID NO: 11362
  strain TW14359 / EHEC

SEQ ID NO: 19774 - protein, 883 aa, Escherichia coli O157:H7; identical to SEQ ID NO: 5702
  strain TW14359 / EHEC

SEQ ID NO: 19775 - protein, 236 aa, Escherichia coli O157:H7; identical to SEQ ID NO: 11364
  strain TW14359 / EHEC

SEQ ID NO: 19776 - protein, 231 aa, Escherichia coli O157:H7; identical to SEQ ID NO: 5724
  strain TW14359 / EHEC

SEQ ID NO: 19777 - protein, 838 aa, Escherichia coli O157:H7; identical to SEQ ID NO: 5723
  strain TW14359 / EHEC

SEQ ID NO: 19778 - protein, 678 aa, Escherichia coli O157:H7; identical to SEQ ID NO: 5722
  strain TW14359 / EHEC

SEQ ID NO: 19779 - protein, 331 aa, Escherichia coli O157:H7; identical to SEQ ID NO: 5720
  strain TW14359 / EHEC

SEQ ID NO: 19780 - protein, 245 aa, Escherichia coli O157:H7; identical to SEQ ID NO: 11918
  strain TW14359 / EHEC

SEQ ID NO: 19781 - protein, 859 aa, Escherichia coli O157:H7; identical to SEQ ID NO: 19736
  strain TW14359 / EHEC

SEQ ID NO: 19782 - protein, 102 aa, Escherichia coli O157:H7; identical to SEQ ID NO: 11707
  strain TW14359 / EHEC

SEQ ID NO: 19783 - protein, 412 aa, Escherichia coli O157:H7; identical to SEQ ID NO: 5719
  strain TW14359 / EHEC

SEQ ID NO: 19784 - protein, 227 aa, Escherichia coli O157:H7; identical to SEQ ID NO: 11429
  strain TW14359 / EHEC

SEQ ID NO: 19785 - protein, 784 aa, Escherichia coli O157:H7; identical to SEQ ID NO: 5705
  strain TW14359 / EHEC

SEQ ID NO: 19786 - protein, 170 aa, Escherichia coli O157:H7; identical to SEQ ID NO: 5855
  strain TW14359 / EHEC

SEQ ID NO: 19787 - protein, 660 aa, Escherichia coli O157:H7; identical to SEQ ID NO: 11731
  strain TW14359 / EHEC

SEQ ID NO: 19788 - protein, 241 aa, Escherichia coli O157:H7; identical to SEQ ID NO: 11431
  strain TW14359 / EHEC

SEQ ID NO: 19789 - protein, 747 aa, Escherichia coli O157:H7; identical to SEQ ID NO: 5775
  strain TW14359 / EHEC

SEQ ID NO: 19790 - protein, 266 aa, Escherichia coli O157:H7; identical to SEQ ID NO: 5771
  strain TW14359 / EHEC

SEQ ID NO: 19791 - protein, 161 aa, Escherichia coli O157:H7; identical to SEQ ID NO: 5769
  strain TW14359 / EHEC

SEQ ID NO: 19792 - protein, 118 aa, Escherichia coli O157:H7 [sequence omitted]

SEQ ID NO: 19793 - protein, 228 aa, Escherichia coli O157:H7; identical to SEQ ID NO: 11499
  strain TW14359 / EHEC

SEQ ID NO: 19794 - protein, 351 aa, Escherichia coli O157:H7; identical to SEQ ID NO: 5767
  strain TW14359 / EHEC

SEQ ID NO: 19795 - protein, 191 aa, Escherichia coli O157:H7; identical to SEQ ID NO: 5701
  strain TW14359 / EHEC

SEQ ID NO: 19796 - protein, 334 aa, Escherichia coli O157:H7; identical to SEQ ID NO: 19634
  strain TW14359 / EHEC

SEQ ID NO: 19797 - protein, 337 aa, Escherichia coli O157:H7; identical to SEQ ID NO: 19525
  strain TW14359 / EHEC

SEQ ID NO: 19798 - protein, 558 aa, Escherichia coli O157:H7; identical to SEQ ID NO: 5974
  strain TW14359 / EHEC

SEQ ID NO: 19799 - protein, 512 aa, Escherichia coli O157:H7; identical to SEQ ID NO: 5948
  strain TW14359 / EHEC

SEQ ID NO: 19800 - protein, 127 aa, Escherichia coli O157:H7; identical to SEQ ID NO: 19633
  strain TW14359 / EHEC

SEQ ID NO: 19801 - protein, 715 aa, Escherichia coli O157:H7; identical to SEQ ID NO: 11710
  strain TW14359 / EHEC

SEQ ID NO: 19802 - protein, 89 aa, Escherichia coli O157:H7; identical to SEQ ID NO: 6053
  strain TW14359 / EHEC

SEQ ID NO: 19803 - protein, 208 aa, Escherichia coli O157:H7; identical to SEQ ID NO: 5717
  strain TW14359 / EHEC

SEQ ID NO: 19804 - protein, 230 aa, Escherichia coli O157:H7; identical to SEQ ID NO: 5765
  strain TW14359 / EHEC

SEQ ID NO: 19805 - protein, 869 aa, Escherichia coli O157:H7; identical to SEQ ID NO: 5763
  strain TW14359 / EHEC

SEQ ID NO: 19806 - protein, 746 aa, Escherichia coli O157:H7; identical to SEQ ID NO: 5761
  strain TW14359 / EHEC

SEQ ID NO: 19807 - protein, 614 aa, Escherichia coli O157:H7; identical to SEQ ID NO: 5715
  strain TW14359 / EHEC

SEQ ID NO: 19808 - protein, 193 aa, Escherichia coli O157:H7; identical to SEQ ID NO: 5760
  strain TW14359 / EHEC

SEQ ID NO: 19809 - protein, 243 aa, Escherichia coli O157:H7; identical to SEQ ID NO: 11367
  strain TW14359 / EHEC

SEQ ID NO: 19810 - protein, 816 aa, Escherichia coli O157:H7; identical to SEQ ID NO: 11682
  strain TW14359 / EHEC

SEQ ID NO: 19811 - protein, 430 aa, Escherichia coli O157:H7; identical to SEQ ID NO: 5758
  strain TW14359 / EHEC

SEQ ID NO: 19812 - protein, 826 aa, Escherichia coli O157:H7; identical to SEQ ID NO: 11397
  strain TW14359 / EHEC

SEQ ID NO: 19813 - protein, 240 aa, Escherichia coli O157:H7
  strain TW14359 / EHEC
MAAIFMAASINIRGIKMKGLLSLLISSMIFPVHAGMVIFGTRIIYPAEQKEVMVQLMNQGNRSSLMQAWIDDGDTSLPPEKIQVPFMLTPPVVKVAANSGQQIKIKIMPNKLPSNKESIFYLNVLDIPPNSPEDEGKNALKFAMQNRIKLFYRPAGIAPVNKTTFKKLRVSRSGNNVVIKNDSPNWVTISDVKANNVKVNYETIMIAPQESQNVSEKNNNANGWQLTIIDDHGNYISDKI

SEQ ID NO: 19814 - protein, 446 aa, Escherichia coli O157:H7; identical to SEQ ID NO: 5714
  strain TW14359 / EHEC

SEQ ID NO: 19815 - protein, 237 aa, Escherichia coli O157:H7; identical to SEQ ID NO: 5713
  strain TW14359 / EHEC

SEQ ID NO: 19816 - protein, 478 aa, Escherichia coli O157:H7; identical to SEQ ID NO: 5712
  strain TW14359 / EHEC

SEQ ID NO: 19817 - protein, 332 aa, Escherichia coli O157:H7; identical to SEQ ID NO: 5757
  strain TW14359 / EHEC

SEQ ID NO: 19818 - protein, 760 aa, Escherichia coli O157:H7; identical to SEQ ID NO: 5756
  strain TW14359 / EHEC

SEQ ID NO: 19819 - protein, 659 aa, Escherichia coli O157:H7; identical to SEQ ID NO: 5736
  strain TW14359 / EHEC

SEQ ID NO: 19820 - protein, 828 aa, Escherichia coli O157:H7; identical to SEQ ID NO: 5735
  strain TW14359 / EHEC

SEQ ID NO: 19821 - protein, 162 aa, Escherichia coli O157:H7; identical to SEQ ID NO: 5734
  strain TW14359 / EHEC

SEQ ID NO: 19822 - protein, 367 aa, Escherichia coli O157:H7; identical to SEQ ID NO: 5700
  strain TW14359 / EHEC

SEQ ID NO: 19823 - protein, 200 aa, Escherichia coli O157:H7; identical to SEQ ID NO: 5733
  strain TW14359 / EHEC

SEQ ID NO: 19824 - protein, 650 aa, Escherichia coli O157:H7; identical to SEQ ID NO: 11539
  strain TW14359 / EHEC

SEQ ID NO: 19825 - protein, 998 aa, Escherichia coli O157:H7; identical to SEQ ID NO: 5657
  strain TW14359 / EHEC

SEQ ID NO: 19826 - protein, 89 aa, Escherichia coli O157:H7 str. 1044; identical to SEQ ID NO: 6233

SEQ ID NO: 19827 - protein, 998 aa, Escherichia coli O157:H7 str. 1044; identical to SEQ ID NO: 6058

SEQ ID NO: 19828 - protein, 650 aa, Escherichia coli O157:H7 str. 1044; identical to SEQ ID NO: 11539

SEQ ID NO: 19829 - protein, 407 aa, Escherichia coli O157:H7 str. 1044; identical to SEQ ID NO: 19575

SEQ ID NO: 19830 - protein, 713 aa, Escherichia coli O157:H7 str. 1044; identical to SEQ ID NO: 11411

SEQ ID NO: 19831 - protein, 231 aa, Escherichia coli O157:H7 str. 1044; identical to SEQ ID NO: 5724

SEQ ID NO: 19832 - protein, 863 aa, Escherichia coli O157:H7 str. 1044; identical to SEQ ID NO: 19681

SEQ ID NO: 19833 - protein, 678 aa, Escherichia coli O157:H7 str. 1044; identical to SEQ ID NO: 5722

SEQ ID NO: 19834 - protein, 368 aa, Escherichia coli O157:H7 str. 1044; identical to SEQ ID NO: 11425

SEQ ID NO: 19835 - protein, 241 aa, Escherichia coli O157:H7 str. 1044; identical to SEQ ID NO: 5709

SEQ ID NO: 19836 - protein, 856 aa, Escherichia coli O157:H7 str. 1044; identical to SEQ ID NO: 11664

SEQ ID NO: 19837 - protein, 816 aa, Escherichia coli O157:H7 str. 1044; identical to SEQ ID NO: 11428

SEQ ID NO: 19838 - protein, 227 aa, Escherichia coli O157:H7 str. 1044; identical to SEQ ID NO: 11429

SEQ ID NO: 19839 - protein, 446 aa, Escherichia coli O157:H7 str. 1044; identical to SEQ ID NO: 5714

SEQ ID NO: 19840 - protein, 237 aa, Escherichia coli O157:H7 str. 1044; identical to SEQ ID NO: 5713

SEQ ID NO: 19841 - protein, 478 aa, Escherichia coli O157:H7 str. 1044; identical to SEQ ID NO: 5711

SEQ ID NO: 19842 - protein, 173 aa, Escherichia coli O157:H7 str. 1044; identical to SEQ ID NO: 11376

SEQ ID NO: 19843 - protein, 630 aa, Escherichia coli O157:H7 str. 1044; identical to SEQ ID NO: 11690

SEQ ID NO: 19844 - protein, 224 aa, Escherichia coli O157:H7 str. 1044; identical to SEQ ID NO: 11374

SEQ ID NO: 19845 - protein, 362 aa, Escherichia coli O157:H7 str. 1044; identical to SEQ ID NO: 5754

SEQ ID NO: 19846 - protein, 203 aa, Escherichia coli O157:H7 str. 1044; identical to SEQ ID NO: 6414

SEQ ID NO: 19847 - protein, 760 aa, Escherichia coli O157:H7 str. 1044; identical to SEQ ID NO: 5756

SEQ ID NO: 19848 - protein, 331 aa, Escherichia coli O157:H7 str. 1044; identical to SEQ ID NO: 6551

SEQ ID NO: 19849 - protein, 840 aa, Escherichia coli O157:H7 str. 1044; identical to SEQ ID NO: 11380

SEQ ID NO: 19850 - protein, 233 aa, Escherichia coli O157:H7 str. 1044; identical to SEQ ID NO: 11381

SEQ ID NO: 19851 - protein, 209 aa, Escherichia coli O157:H7 str. 1044; identical to SEQ ID NO: 11379

SEQ ID NO: 19852 - protein, 669 aa, Escherichia coli O157:H7 str. 1044; identical to SEQ ID NO: 8890

SEQ ID NO: 19853 - protein, 518 aa, Escherichia coli O157:H7 str. 1044; identical to SEQ ID NO: 11400

SEQ ID NO: 19854 - protein, 232 aa, Escherichia coli O157:H7 str. 1044; identical to SEQ ID NO: 5747

SEQ ID NO: 19855 - protein, 191 aa, Escherichia coli O157:H7 str. 1044; identical to SEQ ID NO: 5748

SEQ ID NO: 19856 - protein, 89 aa, Escherichia coli O157:H7 str. 1044; identical to SEQ ID NO: 6232

SEQ ID NO: 19857 - protein, 627 aa, Escherichia coli O157:H7 str. 1044; identical to SEQ ID NO: 11401

SEQ ID NO: 19858 - protein, 828 aa, Escherichia coli O157:H7 str. 1044; identical to SEQ ID NO: 5735

SEQ ID NO: 19859 - protein, 162 aa, Escherichia coli O157:H7 str. 1044; identical to SEQ ID NO: 5734

SEQ ID NO: 19860 - protein, 367 aa, Escherichia coli O157:H7 str. 1044; identical to SEQ ID NO: 5700

SEQ ID NO: 19861 - protein, 200 aa, Escherichia coli O157:H7 str. 1044; identical to SEQ ID NO: 5732

SEQ ID NO: 19862 - protein, 274 aa, Escherichia coli O157:H7 str. 1044; identical to SEQ ID NO: 5731

SEQ ID NO: 19863 - protein, 252 aa, Escherichia coli O157:H7 str. 1044; identical to SEQ ID NO: 11406

SEQ ID NO: 19864 - protein, 860 aa, Escherichia coli O157:H7 str. 1044; identical to SEQ ID NO: 11407

SEQ ID NO: 19865 - protein, 203 aa, Escherichia coli O157:H7 str. 1044; identical to SEQ ID NO: 6347

SEQ ID NO: 19866 - protein, 656 aa, Escherichia coli O157:H7 str. 1044; identical to SEQ ID NO: 11390

SEQ ID NO: 19867 - protein, 207 aa, Escherichia coli O157:H7 str. 1044; identical to SEQ ID NO: 5743

SEQ ID NO: 19868 - protein, 839 aa, Escherichia coli O157:H7 str. 1044
MGWRSLFQAVAEPFAGAWQQGVKADPETVLSFHAVFSCISLISQDIAKMRLRLMQTDVQGIRREKRQGDTARLCRRPNAQQNRIQFFELWLNSKLRHGNTVVLKIRTPRGQIKELRILDWNRVEPLVADDGEVFYRITPDRNCGITESVTVPAREVIHDRFNCFFHPLVGLPPVYAAGLAAMQGHHIQANSTYFFRNGGRPSGVIEVPGSITEENAKKLKGNWDSGYTGENAGKTAILSNGAKYSPTTFSPVDAQTVEQLKMTAEIVCSVFRVPAYKIGVGHPPSSDNVEALEQQYYSQCLQTLIESIELLLDEALETGENESTEFDVTTLLRMDSERRMKTLGDAVKNTLLTPNEARKRENLPPLAGGDALYLQQQNYSLEALSRRDAREDPFASAGKTVSSQLPDGASDGNKAISETEHDAVKAMFRGDTEKMTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 19869 - protein, 111 aa, Escherichia coli O157:H7 str. 1044; identical to SEQ ID NO: 5738

SEQ ID NO: 19870 - protein, 122 aa, Escherichia coli O157:H7 str. 1044; identical to SEQ ID NO: 5737

SEQ ID NO: 19871 - protein, 430 aa, Escherichia coli O157:H7 str. 1044; identical to SEQ ID NO: 5758

SEQ ID NO: 19872 - protein, 720 aa, Escherichia coli O157:H7 str. 1044; identical to SEQ ID NO: 11368

SEQ ID NO: 19873 - protein, 243 aa, Escherichia coli O157:H7 str. 1044; identical to SEQ ID NO: 11367

SEQ ID NO: 19874 - protein, 230 aa, Escherichia coli O157:H7 str. 1044; identical to SEQ ID NO: 5765

SEQ ID NO: 19875 - protein, 869 aa, Escherichia coli O157:H7 str. 1044; identical to SEQ ID NO: 5763

SEQ ID NO: 19876 - protein, 746 aa, Escherichia coli O157:H7 str. 1044; identical to SEQ ID NO: 5761

SEQ ID NO: 19877 - protein, 193 aa, Escherichia coli O157:H7 str. 1044; identical to SEQ ID NO: 5760

SEQ ID NO: 19878 - protein, 236 aa, Escherichia coli O157:H7 str. 1044; identical to SEQ ID NO: 11364

SEQ ID NO: 19879 - protein, 871 aa, Escherichia coli O157:H7 str. 1044
MHQVLLLPRFARLTIALSLATAVFPVDAEYYFNPRFLSNDLAESVDLSAFTKGREAPPGTYRVDIYLNDEFMTSRDITFITDDNNADLIPCLSTDLLVSLGIKKSALLDNKEHSAEKHVPDNSACTPLQDRLVDASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPRFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRDQEQISISQQLGNYGATFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSTLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 19880 - protein, 366 aa, Escherichia coli O157:H7 str. 1044; identical to SEQ ID NO: 11362

SEQ ID NO: 19881 - protein, 700 aa, Escherichia coli O157:H7 str. 1044; identical to SEQ ID NO: 5740

SEQ ID NO: 19882 - protein, 539 aa, Escherichia coli O157:H7 str. 1044; identical to SEQ ID NO: 6525

SEQ ID NO: 19883 - protein, 729 aa, Escherichia coli O157:H7 str. 1044; identical to SEQ ID NO: 5745

SEQ ID NO: 19884 - protein, 213 aa, Escherichia coli O157:H7 str. 1044; identical to SEQ ID NO: 5744

SEQ ID NO: 19885 - protein, 161 aa, Escherichia coli O157:H7 str. 1044; identical to SEQ ID NO: 5769

SEQ ID NO: 19886 - protein, 266 aa, Escherichia coli O157:H7 str. 1044; identical to SEQ ID NO: 5771

SEQ ID NO: 19887 - protein, 747 aa, Escherichia coli O157:H7 str. 1044; identical to SEQ ID NO: 5774

SEQ ID NO: 19888 - protein, 241 aa, Escherichia coli O157:H7 str. 1044; identical to SEQ ID NO: 11431

SEQ ID NO: 19889 - protein, 359 aa, Escherichia coli O157:H7 str. 1044; identical to SEQ ID NO: 11410

SEQ ID NO: 19890 - protein, 432 aa, Escherichia coli O157:H7 str. 1044; identical to SEQ ID NO: 5727

SEQ ID NO: 19891 - protein, 351 aa, Escherichia coli O157:H7 str. 1044; identical to SEQ ID NO: 5767

SEQ ID NO: 19892 - protein, 715 aa, Escherichia coli O157:H7 str. 1044; identical to SEQ ID NO: 11710

SEQ ID NO: 19893 - protein, 826 aa, Escherichia coli O157:H7 str. 1044; identical to SEQ ID NO: 11397

SEQ ID NO: 19894 - protein, 224 aa, Escherichia coli O157:H7 str. 1044; identical to SEQ ID NO: 11398

SEQ ID NO: 19895 - protein, 614 aa, Escherichia coli O157:H7 str. 1044; identical to SEQ ID NO: 5715

SEQ ID NO: 19896 - protein, 208 aa, Escherichia coli O157:H7 str. 1044; identical to SEQ ID NO: 5717

SEQ ID NO: 19897 - protein, 660 aa, Escherichia coli O157:H7 str. 1044; identical to SEQ ID NO: 6039

SEQ ID NO: 19898 - protein, 386 aa, Escherichia coli O157:H7 str. 1044; identical to SEQ ID NO: 11415

SEQ ID NO: 19899 - protein, 108 aa, Escherichia coli O157:H7 str. 1044; identical to SEQ ID NO: 11583

SEQ ID NO: 19900 - protein, 512 aa, Escherichia coli O157:H7 str. 1044; identical to SEQ ID NO: 5948

SEQ ID NO: 19901 - protein, 229 aa, Escherichia coli O157:H7 str. 1044; identical to SEQ ID NO: 11418

SEQ ID NO: 19902 - protein, 367 aa, Escherichia coli O157:H7 str. 1044; identical to SEQ ID NO: 11417

SEQ ID NO: 19903 - protein, 224 aa, Escherichia coli O157:H7 str. 1125; identical to SEQ ID NO: 11398

SEQ ID NO: 19904 - protein, 826 aa, Escherichia coli O157:H7 str. 1125; identical to SEQ ID NO: 11397

SEQ ID NO: 19905 - protein, 715 aa, Escherichia coli O157:H7 str. 1125; identical to SEQ ID NO: 11710

SEQ ID NO: 19906 - protein, 207 aa, Escherichia coli O157:H7 str. 1125; identical to SEQ ID NO: 5743

SEQ ID NO: 19907 - protein, 656 aa, Escherichia coli O157:H7 str. 1125; identical to SEQ ID NO: 11390

SEQ ID NO: 19908 - protein, 203 aa, Escherichia coli O157:H7 str. 1125; identical to SEQ ID NO: 6347

SEQ ID NO: 19909 - protein, 430 aa, Escherichia coli O157:H7 str. 1125; identical to SEQ ID NO: 5758

SEQ ID NO: 19910 - protein, 816 aa, Escherichia coli O157:H7 str. 1125; identical to SEQ ID NO: 11682

SEQ ID NO: 19911 - protein, 243 aa, Escherichia coli O157:H7 str. 1125; identical to SEQ ID NO: 11367

SEQ ID NO: 19912 - protein, 193 aa, Escherichia coli O157:H7 str. 1125; identical to SEQ ID NO: 5760

SEQ ID NO: 19913 - protein, 746 aa, Escherichia coli O157:H7 str. 1125; identical to SEQ ID NO: 5761

SEQ ID NO: 19914 - protein, 869 aa, Escherichia coli O157:H7 str. 1125; identical to SEQ ID NO: 5763

SEQ ID NO: 19915 - protein, 230 aa, Escherichia coli O157:H7 str. 1125; identical to SEQ ID NO: 5765

SEQ ID NO: 19916 - protein, 227 aa, Escherichia coli O157:H7 str. 1125; identical to SEQ ID NO: 11429

SEQ ID NO: 19917 - protein, 816 aa, Escherichia coli O157:H7 str. 1125; identical to SEQ ID NO: 11428

SEQ ID NO: 19918 - protein, 863 aa, Escherichia coli O157:H7 str. 1125; identical to SEQ ID NO: 11427

SEQ ID NO: 19919 - protein, 241 aa, Escherichia coli O157:H7 str. 1125; identical to SEQ ID NO: 5709

SEQ ID NO: 19920 - protein, 368 aa, Escherichia coli O157:H7 str. 1125; identical to SEQ ID NO: 11425

SEQ ID NO: 19921 - protein, 161 aa, Escherichia coli O157:H7 str. 1125; identical to SEQ ID NO: 5769

SEQ ID NO: 19922 - protein, 266 aa, Escherichia coli O157:H7 str. 1125; identical to SEQ ID NO: 5771

SEQ ID NO: 19923 - protein, 747 aa, Escherichia coli O157:H7 str. 1125; identical to SEQ ID NO: 5775

SEQ ID NO: 19924 - protein, 241 aa, Escherichia coli O157:H7 str. 1125; identical to SEQ ID NO: 11431

SEQ ID NO: 19925 - protein, 386 aa, Escherichia coli O157:H7 str. 1125; identical to SEQ ID NO: 11415

SEQ ID NO: 19926 - protein, 111 aa, Escherichia coli O157:H7 str. 1125; identical to SEQ ID NO: 5739

SEQ ID NO: 19927 - protein, 122 aa, Escherichia coli O157:H7 str. 1125; identical to SEQ ID NO: 5737

SEQ ID NO: 19928 - protein, 432 aa, Escherichia coli O157:H7 str. 1125; identical to SEQ ID NO: 5727

SEQ ID NO: 19929 - protein, 359 aa, Escherichia coli O157:H7 str. 1125; identical to SEQ ID NO: 11410

SEQ ID NO: 19930 - protein, 208 aa, Escherichia coli O157:H7 str. 1125; identical to SEQ ID NO: 5717

SEQ ID NO: 19931 - protein, 614 aa, Escherichia coli O157:H7 str. 1125; identical to SEQ ID NO: 5715

SEQ ID NO: 19932 - protein, 245 aa, Escherichia coli O157:H7 str. 1125; identical to SEQ ID NO: 11918

SEQ ID NO: 19933 - protein, 351 aa, Escherichia coli O157:H7 str. 1125; identical to SEQ ID NO: 5767

SEQ ID NO: 19934 - protein, 478 aa, Escherichia coli O157:H7 str. 1125; identical to SEQ ID NO: 5711

SEQ ID NO: 19935 - protein, 237 aa, Escherichia coli O157:H7 str. 1125; identical to SEQ ID NO: 5713

SEQ ID NO: 19936 - protein, 125 aa, Escherichia coli O157:H7 str. 1125; identical to SEQ ID NO: 11420

SEQ ID NO: 19937 - protein, 512 aa, Escherichia coli O157:H7 str. 1125; identical to SEQ ID NO: 5948

SEQ ID NO: 19938 - protein, 539 aa, Escherichia coli O157:H7 str. 1125; identical to SEQ ID NO: 6525

SEQ ID NO: 19939 - protein, 236 aa, Escherichia coli O157:H7 str. 1125; identical to SEQ ID NO: 11364

SEQ ID NO: 19940 - protein, 871 aa, Escherichia coli O157:H7 str. 1125; identical to SEQ ID NO: 11363

SEQ ID NO: 19941 - protein, 366 aa, Escherichia coli O157:H7 str. 1125; identical to SEQ ID NO: 11362

SEQ ID NO: 19942 - protein, 700 aa, Escherichia coli O157:H7 str. 1125; identical to SEQ ID NO: 5740

SEQ ID NO: 19943 - protein, 859 aa, Escherichia coli O157:H7 str. 1125
MWNLLRRTRKNQKSGRDVREAGWTSLFQAVAEPFSGAWQQGVKADPEAVLSFHAVFACISLISQDIAKMRLRLMQTDAHGIRRETRRGDIARLCRRPNAQQNRIQFFELWLNAKLRHGNTVVLKIRNARWQIKELRILDWSRVEPLVADDGEVFYRITPDRNCGITEAVTVPAREVIHDRFNCFFHPLIGLPPVYAAGLAATQGHHIQENSTSFFRNGGRPSGVIEIPGSITEENAKKLKSNWDSGYTGENAGKTAILSNGAKYNPTTFSPVDAQTVEQLKMTAEIVCSVFRVPAYKIGVGQPPSSDNVEALEQQYYSQCLQTLIESIELLLDEALETGENESTEFDVTTLLRMDSERRMKTLGDAVKNTLLTPNEARKRENLPPLAGGDALYLQQQNYSLEALSRRDAREDPFASAGKTVSSQLPDGASDGNKAISETEHDAVKAMFRGDTEKMTERELSIIRALGEEFSTVLADLQRTFEEKIAAQAQTFEEKLASQSVVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 19944 - protein, 669 aa, Escherichia coli O157:H7 str. 1125; identical to SEQ ID NO: 8890

SEQ ID NO: 19945 - protein, 446 aa, Escherichia coli O157:H7 str. 1125; identical to SEQ ID NO: 5714

SEQ ID NO: 19946 - protein, 518 aa, Escherichia coli O157:H7 str. 1125; identical to SEQ ID NO: 11400

SEQ ID NO: 19947 - protein, 89 aa, Escherichia coli O157:H7 str. 1125; identical to SEQ ID NO: 6233

SEQ ID NO: 19948 - protein, 229 aa, Escherichia coli O157:H7 str. 1125; identical to SEQ ID NO: 11418

SEQ ID NO: 19949 - protein, 367 aa, Escherichia coli O157:H7 str. 1125; identical to SEQ ID NO: 11417

SEQ ID NO: 19950 - protein, 660 aa, Escherichia coli O157:H7 str. 1125; identical to SEQ ID NO: 11731

SEQ ID NO: 19951 - protein, 627 aa, Escherichia coli O157:H7 str. 1125; identical to SEQ ID NO: 11401

SEQ ID NO: 19952 - protein, 828 aa, Escherichia coli O157:H7 str. 1125; identical to SEQ ID NO: 5735

SEQ ID NO: 19953 - protein, 162 aa, Escherichia coli O157:H7 str. 1125; identical to SEQ ID NO: 5734

SEQ ID NO: 19954 - protein, 367 aa, Escherichia coli O157:H7 str. 1125; identical to SEQ ID NO: 5700

SEQ ID NO: 19955 - protein, 200 aa, Escherichia coli O157:H7 str. 1125; identical to SEQ ID NO: 5732

SEQ ID NO: 19956 - protein, 274 aa, Escherichia coli O157:H7 str. 1125; identical to SEQ ID NO: 5731

SEQ ID NO: 19957 - protein, 252 aa, Escherichia coli O157:H7 str. 1125; identical to SEQ ID NO: 11406

SEQ ID NO: 19958 - protein, 532 aa, Escherichia coli O157:H7 str. 1125
MPDHSLFRLRVLPCCVALAMSGSYVNAWAENEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTRLLIDADGVAGVPVEGNGAAVYTNMFGKAVVADVNNYYRNQAYIDLNNLPENAEATQSVVQATLTEGAIGYRKFSVISGQKAMAVLRLQDGSYPPFGAEVKNDSAQNVGLVDDDGNVYLAGVKPGEHMIVSWGGVAHCDIHLPDPLPADLFNGLLLPCQQTGAISPSMPHEIKPVIQEQTQQVMPTEAPVSVSAN

SEQ ID NO: 19959 - protein, 517 aa, Escherichia coli O157:H7 str. 1125; identical to SEQ ID NO: 6817

SEQ ID NO: 19960 - protein, 191 aa, Escherichia coli O157:H7 str. 1125; identical to SEQ ID NO: 5748

SEQ ID NO: 19961 - protein, 232 aa, Escherichia coli O157:H7 str. 1125; identical to SEQ ID NO: 5747

SEQ ID NO: 19962 - protein, 729 aa, Escherichia coli O157:H7 str. 1125; identical to SEQ ID NO: 5745

SEQ ID NO: 19963 - protein, 213 aa, Escherichia coli O157:H7 str. 1125; identical to SEQ ID NO: 5744

SEQ ID NO: 19964 - protein, 233 aa, Escherichia coli O157:H7 str. 1125; identical to SEQ ID NO: 11381

SEQ ID NO: 19965 - protein, 840 aa, Escherichia coli O157:H7 str. 1125; identical to SEQ ID NO: 11380

SEQ ID NO: 19966 - protein, 209 aa, Escherichia coli O157:H7 str. 1125; identical to SEQ ID NO: 11379

SEQ ID NO: 19967 - protein, 170 aa, Escherichia coli O157:H7 str. 1125; identical to SEQ ID NO: 11901

SEQ ID NO: 19968 - protein, 630 aa, Escherichia coli O157:H7 str. 1125; identical to SEQ ID NO: 11690

SEQ ID NO: 19969 - protein, 224 aa, Escherichia coli O157:H7 str. 1125; identical to SEQ ID NO: 11374

SEQ ID NO: 19970 - protein, 362 aa, Escherichia coli O157:H7 str. 1125; identical to SEQ ID NO: 5754

SEQ ID NO: 19971 - protein, 203 aa, Escherichia coli O157:H7 str. 1125; identical to SEQ ID NO: 6414

SEQ ID NO: 19972 - protein, 760 aa, Escherichia coli O157:H7 str. 1125; identical to SEQ ID NO: 5756

SEQ ID NO: 19973 - protein, 331 aa, Escherichia coli O157:H7 str. 1125; identical to SEQ ID NO: 6551

SEQ ID NO: 19974 - protein, 689 aa, Escherichia coli O157:H7 str. 1125; identical to SEQ ID NO: 11798

SEQ ID NO: 19975 - protein, 231 aa, Escherichia coli O157:H7 str. 1125; identical to SEQ ID NO: 5724

SEQ ID NO: 19976 - protein, 863 aa, Escherichia coli O157:H7 str. 1125; identical to SEQ ID NO: 19681

SEQ ID NO: 19977 - protein, 678 aa, Escherichia coli O157:H7 str. 1125; identical to SEQ ID NO: 5722

SEQ ID NO: 19978 - protein, 998 aa, Escherichia coli O157:H7 str. 1125; identical to SEQ ID NO: 5657

SEQ ID NO: 19979 - protein, 650 aa, Escherichia coli O157:H7 str. 1125; identical to SEQ ID NO: 11539

SEQ ID NO: 19980 - protein, 230 aa, Escherichia coli O157:H7 str. EC1212; identical to SEQ ID NO: 5765

SEQ ID NO: 19981 - protein, 869 aa, Escherichia coli O157:H7 str. EC1212; identical to SEQ ID NO: 5763

SEQ ID NO: 19982 - protein, 746 aa, Escherichia coli O157:H7 str. EC1212; identical to SEQ ID NO: 5761

SEQ ID NO: 19983 - protein, 193 aa, Escherichia coli O157:H7 str. EC1212; identical to SEQ ID NO: 5760

SEQ ID NO: 19984 - protein, 243 aa, Escherichia coli O157:H7 str. EC1212; identical to SEQ ID NO: 11367

SEQ ID NO: 19985 - protein, 816 aa, Escherichia coli O157:H7 str. EC1212; identical to SEQ ID NO: 11682

SEQ ID NO: 19986 - protein, 430 aa, Escherichia coli O157:H7 str. EC1212; identical to SEQ ID NO: 5758

SEQ ID NO: 19987 - protein, 760 aa, Escherichia coli O157:H7 str. EC1212
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTATLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTASIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADVKLGYRVNRNLDFQLNVYNLFDTDYVASINKSGYRYHPGEPRTFLLTANMHF

SEQ ID NO: 19988 - protein, 331 aa, Escherichia coli O157:H7 str. EC1212; identical to SEQ ID NO: 6551

SEQ ID NO: 19989 - protein, 170 aa, Escherichia coli O157:H7 str. EC1212; identical to SEQ ID NO: 11451

SEQ ID NO: 19990 - protein, 630 aa, Escherichia coli O157:H7 str. EC1212; identical to SEQ ID NO: 11690

SEQ ID NO: 19991 - protein, 224 aa, Escherichia coli O157:H7 str. EC1212; identical to SEQ ID NO: 11374

SEQ ID NO: 19992 - protein, 362 aa, Escherichia coli O157:H7 str. EC1212; identical to SEQ ID NO: 5754

SEQ ID NO: 19993 - protein, 203 aa, Escherichia coli O157:H7 str. EC1212; identical to SEQ ID NO: 6414

SEQ ID NO: 19994 - protein, 233 aa, Escherichia coli O157:H7 str. EC1212; identical to SEQ ID NO: 11381

SEQ ID NO: 19995 - protein, 840 aa, Escherichia coli O157:H7 str. EC1212; identical to SEQ ID NO: 11380

SEQ ID NO: 19996 - protein, 209 aa, Escherichia coli O157:H7 str. EC1212; identical to SEQ ID NO: 11379

SEQ ID NO: 19997 - protein, 860 aa, Escherichia coli O157:H7 str. EC1212; identical to SEQ ID NO: 11720

SEQ ID NO: 19998 - protein, 252 aa, Escherichia coli O157:H7 str. EC1212; identical to SEQ ID NO: 11406

SEQ ID NO: 19999 - protein, 274 aa, Escherichia coli O157:H7 str. EC1212; identical to SEQ ID NO: 5731

SEQ ID NO: 20000 - protein, 200 aa, Escherichia coli O157:H7 str. EC1212; identical to SEQ ID NO: 5732

SEQ ID NO: 20001 - protein, 367 aa, Escherichia coli O157:H7 str. EC1212; identical to SEQ ID NO: 5700

SEQ ID NO: 20002 - protein, 162 aa, Escherichia coli O157:H7 str. EC1212; identical to SEQ ID NO: 5734

SEQ ID NO: 20003 - protein, 828 aa, Escherichia coli O157:H7 str. EC1212; identical to SEQ ID NO: 5735

SEQ ID NO: 20004 - protein, 627 aa, Escherichia coli O157:H7 str. EC1212
MVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLAREDWSFYVSGHYTGQKRADSATAKTPGGYTIWNTGAAWQVTKDVKLRAGVLNLGDKDLSRDDYSYNEDGRRYFMAVDYRF

SEQ ID NO: 20005 - protein, 224 aa, Escherichia coli O157:H7 str. EC1212; identical to SEQ ID NO: 11398

SEQ ID NO: 20006 - protein, 826 aa, Escherichia coli O157:H7 str. EC1212; identical to SEQ ID NO: 11397

SEQ ID NO: 20007 - protein, 89 aa, Escherichia coli O157:H7 str. EC1212; identical to SEQ ID NO: 6053

SEQ ID NO: 20008 - protein, 229 aa, Escherichia coli O157:H7 str. EC1212; identical to SEQ ID NO: 11418

SEQ ID NO: 20009 - protein, 367 aa, Escherichia coli O157:H7 str. EC1212
MSRKTVSRTFSSFSISVVAVAVASTFSAHAGKFNPKFLEDVQGVGQHVDLTMFEKGQEQQLPGIYRVSVYVNEQRMETRTLEFKEATEAQRKAMGESLVPCLSRTQLAEMGVRVESFPALNLVSAEACVPFDEIIPLASSHFDFSEQKLVLSFPQAAMHQVARGTVPESLWDEGIPALLLDYSFSGSNSEYDSTGSSSSYVDDNGTVHHDDGKDTLKSDSYYLNLRSGLNLGAWRLRNYSTWSHSGGKAQWDNIGTSLSRAIIPFKAQLTMGDTATAGDIFDSVQMRGAMLDSDEEMLPDSQRGFAPIVRGIAKSNAEVSIEQNGYVIYRTYVQPGAFEINDLYPTANSGDLTVIIKEADGSEQRFI

SEQ ID NO: 20010 - protein, 161 aa, Escherichia coli O157:H7 str. EC1212; identical to SEQ ID NO: 5769

SEQ ID NO: 20011 - protein, 266 aa, Escherichia coli O157:H7 str. EC1212; identical to SEQ ID NO: 5771

SEQ ID NO: 20012 - protein, 478 aa, Escherichia coli O157:H7 str. EC1212; identical to SEQ ID NO: 5711

SEQ ID NO: 20013 - protein, 747 aa, Escherichia coli O157:H7 str. EC1212; identical to SEQ ID NO: 5775

SEQ ID NO: 20014 - protein, 241 aa, Escherichia coli O157:H7 str. EC1212; identical to SEQ ID NO: 11431

SEQ ID NO: 20015 - protein, 237 aa, Escherichia coli O157:H7 str. EC1212; identical to SEQ ID NO: 5713

SEQ ID NO: 20016 - protein, 629 aa, Escherichia coli O157:H7 str. EC1212; identical to SEQ ID NO: 11941

SEQ ID NO: 20017 - protein, 446 aa, Escherichia coli O157:H7 str. EC1212; identical to SEQ ID NO: 5714

SEQ ID NO: 20018 - protein, 614 aa, Escherichia coli O157:H7 str. EC1212; identical to SEQ ID NO: 5715

SEQ ID NO: 20019 - protein, 227 aa, Escherichia coli O157:H7 str. EC1212; identical to SEQ ID NO: 11429

SEQ ID NO: 20020 - protein, 816 aa, Escherichia coli O157:H7 str. EC1212; identical to SEQ ID NO: 11428

SEQ ID NO: 20021 - protein, 208 aa, Escherichia coli O157:H7 str. EC1212; identical to SEQ ID NO: 5717

SEQ ID NO: 20022 - protein, 386 aa, Escherichia coli O157:H7 str. EC1212; identical to SEQ ID NO: 11415

SEQ ID NO: 20023 - protein, 710 aa, Escherichia coli O157:H7 str. EC1212
MSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLARNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGGAYRLARLCRAALCH

SEQ ID NO: 20024 - protein, 241 aa, Escherichia coli O157:H7 str. EC1212; identical to SEQ ID NO: 5709

SEQ ID NO: 20025 - protein, 368 aa, Escherichia coli O157:H7 str. EC1212; identical to SEQ ID NO: 11425

SEQ ID NO: 20026 - protein, 108 aa, Escherichia coli O157:H7 str. EC1212; identical to SEQ ID NO: 11583

SEQ ID NO: 20027 - protein, 512 aa, Escherichia coli O157:H7 str. EC1212; identical to SEQ ID NO: 5948

SEQ ID NO: 20028 - protein, 351 aa, Escherichia coli O157:H7 str. EC1212; identical to SEQ ID NO: 5767

SEQ ID NO: 20029 - protein, 236 aa, Escherichia coli O157:H7 str. EC1212; identical to SEQ ID NO: 11364

SEQ ID NO: 20030 - protein, 871 aa, Escherichia coli O157:H7 str. EC1212; identical to SEQ ID NO: 11363

SEQ ID NO: 20031 - protein, 366 aa, Escherichia coli O157:H7 str. EC1212; identical to SEQ ID NO: 11362

SEQ ID NO: 20032 - protein, 700 aa, Escherichia coli O157:H7 str. EC1212; identical to SEQ ID NO: 5740

SEQ ID NO: 20033 - protein, 539 aa, Escherichia coli O157:H7 str. EC1212; identical to SEQ ID NO: 6525

SEQ ID NO: 20034 - protein, 191 aa, Escherichia coli O157:H7 str. EC1212; identical to SEQ ID NO: 5748

SEQ ID NO: 20035 - protein, 232 aa, Escherichia coli O157:H7 str. EC1212; identical to SEQ ID NO: 5747

SEQ ID NO: 20036 - protein, 715 aa, Escherichia coli O157:H7 str. EC1212
MLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTIGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 20037 - protein, 432 aa, Escherichia coli O157:H7 str. EC1212; identical to SEQ ID NO: 5727

SEQ ID NO: 20038 - protein, 518 aa, Escherichia coli O157:H7 str. EC1212; identical to SEQ ID NO: 11400

SEQ ID NO: 20039 - protein, 231 aa, Escherichia coli O157:H7 str. EC1212; identical to SEQ ID NO: 5724

SEQ ID NO: 20040 - protein, 838 aa, Escherichia coli O157:H7 str. EC1212; identical to SEQ ID NO: 5723

SEQ ID NO: 20041 - protein, 678 aa, Escherichia coli O157:H7 str. EC1212; identical to SEQ ID NO: 5722

SEQ ID NO: 20042 - protein, 359 aa, Escherichia coli O157:H7 str. EC1212; identical to SEQ ID NO: 11410

SEQ ID NO: 20043 - protein, 713 aa, Escherichia coli O157:H7 str. EC1212; identical to SEQ ID NO: 11726

SEQ ID NO: 20044 - protein, 122 aa, Escherichia coli O157:H7 str. EC1212; identical to SEQ ID NO: 5737

SEQ ID NO: 20045 - protein, 111 aa, Escherichia coli O157:H7 str. EC1212; identical to SEQ ID NO: 5738

SEQ ID NO: 20046 - protein, 669 aa, Escherichia coli O157:H7 str. EC1212; identical to SEQ ID NO: 8890

SEQ ID NO: 20047 - protein, 729 aa, Escherichia coli O157:H7 str. EC1212; identical to SEQ ID NO: 5745

SEQ ID NO: 20048 - protein, 213 aa, Escherichia coli O157:H7 str. EC1212; identical to SEQ ID NO: 5744

SEQ ID NO: 20049 - protein, 203 aa, Escherichia coli O157:H7 str. EC1212; identical to SEQ ID NO: 6347

SEQ ID NO: 20050 - protein, 656 aa, Escherichia coli O157:H7 str. EC1212; identical to SEQ ID NO: 11390

SEQ ID NO: 20051 - protein, 207 aa, Escherichia coli O157:H7 str. EC1212; identical to SEQ ID NO: 5743

SEQ ID NO: 20052 - protein, 998 aa, Escherichia coli O157:H7 str. EC1212; identical to SEQ ID NO: 6058

SEQ ID NO: 20053 - protein, 650 aa, Escherichia coli O157:H7 str. EC1212; identical to SEQ ID NO: 11539

SEQ ID NO: 20054 - protein, 715 aa, Escherichia coli O157:H7 str. EC4042; identical to SEQ ID NO: 11710

SEQ ID NO: 20055 - protein, 89 aa, Escherichia coli O157:H7 str. EC4042; identical to SEQ ID NO: 6053

SEQ ID NO: 20056 - protein, 412 aa, Escherichia coli O157:H7 str. EC4042; identical to SEQ ID NO: 5719

SEQ ID NO: 20057 - protein, 660 aa, Escherichia coli O157:H7 str. EC4042; identical to SEQ ID NO: 11731

SEQ ID NO: 20058 - protein, 826 aa, Escherichia coli O157:H7 str. EC4042; identical to SEQ ID NO: 11397

SEQ ID NO: 20059 - protein, 224 aa, Escherichia coli O157:H7 str. EC4042; identical to SEQ ID NO: 11398

SEQ ID NO: 20060 - protein, 229 aa, Escherichia coli O157:H7 str. EC4042; identical to SEQ ID NO: 11418

SEQ ID NO: 20061 - protein, 659 aa, Escherichia coli O157:H7 str. EC4042; identical to SEQ ID NO: 5736

SEQ ID NO: 20062 - protein, 512 aa, Escherichia coli O157:H7 str. EC4042; identical to SEQ ID NO: 5948

SEQ ID NO: 20063 - protein, 162 aa, Escherichia coli O157:H7 str. EC4042; identical to SEQ ID NO: 5734

SEQ ID NO: 20064 - protein, 367 aa, Escherichia coli O157:H7 str. EC4042; identical to SEQ ID NO: 5700

SEQ ID NO: 20065 - protein, 200 aa, Escherichia coli O157:H7 str. EC4042; identical to SEQ ID NO: 5733

SEQ ID NO: 20066 - protein, 274 aa, Escherichia coli O157:H7 str. EC4042; identical to SEQ ID NO: 5731

SEQ ID NO: 20067 - protein, 252 aa, Escherichia coli O157:H7 str. EC4042; identical to SEQ ID NO: 11406

SEQ ID NO: 20068 - protein, 860 aa, Escherichia coli O157:H7 str. EC4042; identical to SEQ ID NO: 11720

SEQ ID NO: 20069 - protein, 89 aa, Escherichia coli O157:H7 str. EC4042; identical to SEQ ID NO: 6233

SEQ ID NO: 20070 - protein, 208 aa, Escherichia coli O157:H7 str. EC4042; identical to SEQ ID NO: 5717

SEQ ID NO: 20071 - protein, 614 aa, Escherichia coli O157:H7 str. EC4042; identical to SEQ ID NO: 5715

SEQ ID NO: 20072 - protein, 446 aa, Escherichia coli O157:H7 str. EC4042; identical to SEQ ID NO: 5714

SEQ ID NO: 20073 - protein, 237 aa, Escherichia coli O157:H7 str. EC4042; identical to SEQ ID NO: 5713

SEQ ID NO: 20074 - protein, 478 aa, Escherichia coli O157:H7 str. EC4042; identical to SEQ ID NO: 5712

SEQ ID NO: 20075 - protein, 518 aa, Escherichia coli O157:H7 str. EC4042; identical to SEQ ID NO: 11400

SEQ ID NO: 20076 - protein, 539 aa, Escherichia coli O157:H7 str. EC4042; identical to SEQ ID NO: 6525

SEQ ID NO: 20077 - protein, 700 aa, Escherichia coli O157:H7 str. EC4042; identical to SEQ ID NO: 5740

SEQ ID NO: 20078 - protein, 366 aa, Escherichia coli O157:H7 str. EC4042; identical to SEQ ID NO: 11362

SEQ ID NO: 20079 - protein, 871 aa, Escherichia coli O157:H7 str. EC4042; identical to SEQ ID NO: 11363

SEQ ID NO: 20080 - protein, 236 aa, Escherichia coli O157:H7 str. EC4042; identical to SEQ ID NO: 11364

SEQ ID NO: 20081 - protein, 859 aa, Escherichia coli O157:H7 str. EC4042; identical to SEQ ID NO: 19736

SEQ ID NO: 20082 - protein, 432 aa, Escherichia coli O157:H7 str. EC4042; identical to SEQ ID NO: 5727

SEQ ID NO: 20083 - protein, 368 aa, Escherichia coli O157:H7 str. EC4042; identical to SEQ ID NO: 11425

SEQ ID NO: 20084 - protein, 241 aa, Escherichia coli O157:H7 str. EC4042; identical to SEQ ID NO: 5709

SEQ ID NO: 20085 - protein, 863 aa, Escherichia coli O157:H7 str. EC4042; identical to SEQ ID NO: 11427

SEQ ID NO: 20086 - protein, 111 aa, Escherichia coli O157:H7 str. EC4042; identical to SEQ ID NO: 5738

SEQ ID NO: 20087 - protein, 567 aa, Escherichia coli O157:H7 str. EC4042; identical to SEQ ID NO: 11409

SEQ ID NO: 20088 - protein, 227 aa, Escherichia coli O157:H7 str. EC4042; identical to SEQ ID NO: 11429

SEQ ID NO: 20089 - protein, 359 aa, Escherichia coli O157:H7 str. EC4042; identical to SEQ ID NO: 11410

SEQ ID NO: 20090 - protein, 713 aa, Escherichia coli O157:H7 str. EC4042; identical to SEQ ID NO: 11726

SEQ ID NO: 20091 - protein, 262 aa, Escherichia coli O157:H7 str. EC4042
MPAGKPYFREFNLSTDSKECLCFPWLKKTVSALFVSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRPSGLQGEPAEAPAKITWKLNNAQLQANNPTPYYVSFNEVKLESGGKTYNVNSSMVTPFSQASFGVTSLPGSVSSGKVVFKAINDFGGNIDGSATF

SEQ ID NO: 20092 - protein, 747 aa, Escherichia coli O157:H7 str. EC4042; identical to SEQ ID NO: 5775

SEQ ID NO: 20093 - protein, 266 aa, Escherichia coli O157:H7 str. EC4042; identical to SEQ ID NO: 5771

SEQ ID NO: 20094 - protein, 161 aa, Escherichia coli O157:H7 str. EC4042; identical to SEQ ID NO: 5769

SEQ ID NO: 20095 - protein, 122 aa, Escherichia coli O157:H7 str. EC4042; identical to SEQ ID NO: 5737

SEQ ID NO: 20096 - protein, 351 aa, Escherichia coli O157:H7 str. EC4042; identical to SEQ ID NO: 5767

SEQ ID NO: 20097 - protein, 231 aa, Escherichia coli O157:H7 str. EC4042; identical to SEQ ID NO: 5724

SEQ ID NO: 20098 - protein, 863 aa, Escherichia coli O157:H7 str. EC4042; identical to SEQ ID NO: 19681

SEQ ID NO: 20099 - protein, 678 aa, Escherichia coli O157:H7 str. EC4042; identical to SEQ ID NO: 5722

SEQ ID NO: 20100 - protein, 203 aa, Escherichia coli O157:H7 str. EC4042; identical to SEQ ID NO: 6414

SEQ ID NO: 20101 - protein, 362 aa, Escherichia coli O157:H7 str. EC4042; identical to SEQ ID NO: 5754

SEQ ID NO: 20102 - protein, 224 aa, Escherichia coli O157:H7 str. EC4042; identical to SEQ ID NO: 11374

SEQ ID NO: 20103 - protein, 229 aa, Escherichia coli O157:H7 str. EC4042; identical to SEQ ID NO: 11455

SEQ ID NO: 20104 - protein, 233 aa, Escherichia coli O157:H7 str. EC4042; identical to SEQ ID NO: 11381

SEQ ID NO: 20105 - protein, 696 aa, Escherichia coli O157:H7 str. EC4042; identical to SEQ ID NO: 6320

SEQ ID NO: 20106 - protein, 517 aa, Escherichia coli O157:H7 str. EC4042; identical to SEQ ID NO: 6817

SEQ ID NO: 20107 - protein, 191 aa, Escherichia coli O157:H7 str. EC4042; identical to SEQ ID NO: 5748

SEQ ID NO: 20108 - protein, 232 aa, Escherichia coli O157:H7 str. EC4042; identical to SEQ ID NO: 5747

SEQ ID NO: 20109 - protein, 729 aa, Escherichia coli O157:H7 str. EC4042; identical to SEQ ID NO: 5745

SEQ ID NO: 20110 - protein, 213 aa, Escherichia coli O157:H7 str. EC4042; identical to SEQ ID NO: 5744

SEQ ID NO: 20111 - protein, 203 aa, Escherichia coli O157:H7 str. EC4042; identical to SEQ ID NO: 6347

SEQ ID NO: 20112 - protein, 331 aa, Escherichia coli O157:H7 str. EC4042; identical to SEQ ID NO: 6551

SEQ ID NO: 20113 - protein, 760 aa, Escherichia coli O157:H7 str. EC4042; identical to SEQ ID NO: 5756

SEQ ID NO: 20114 - protein, 230 aa, Escherichia coli O157:H7 str. EC4042; identical to SEQ ID NO: 5765

SEQ ID NO: 20115 - protein, 869 aa, Escherichia coli O157:H7 str. EC4042; identical to SEQ ID NO: 5763

SEQ ID NO: 20116 - protein, 746 aa, Escherichia coli O157:H7 str. EC4042; identical to SEQ ID NO: 5761

SEQ ID NO: 20117 - protein, 193 aa, Escherichia coli O157:H7 str. EC4042; identical to SEQ ID NO: 5760

SEQ ID NO: 20118 - protein, 243 aa, Escherichia coli O157:H7 str. EC4042; identical to SEQ ID NO: 11367

SEQ ID NO: 20119 - protein, 816 aa, Escherichia coli O157:H7 str. EC4042; identical to SEQ ID NO: 11682

SEQ ID NO: 20120 - protein, 998 aa, Escherichia coli O157:H7 str. EC4042; identical to SEQ ID NO: 5657

SEQ ID NO: 20121 - protein, 655 aa, Escherichia coli O157:H7 str. EC4042; identical to SEQ ID NO: 11466

SEQ ID NO: 20122 - protein, 518 aa, Escherichia coli O157:H7 str. EC4045; identical to SEQ ID NO: 11400

SEQ ID NO: 20123 - protein, 512 aa, Escherichia coli O157:H7 str. EC4045; identical to SEQ ID NO: 5948

SEQ ID NO: 20124 - protein, 659 aa, Escherichia coli O157:H7 str. EC4045; identical to SEQ ID NO: 5736

SEQ ID NO: 20125 - protein, 231 aa, Escherichia coli O157:H7 str. EC4045; identical to SEQ ID NO: 5724

SEQ ID NO: 20126 - protein, 838 aa, Escherichia coli O157:H7 str. EC4045; identical to SEQ ID NO: 5723

SEQ ID NO: 20127 - protein, 678 aa, Escherichia coli O157:H7 str. EC4045; identical to SEQ ID NO: 5722

SEQ ID NO: 20128 - protein, 227 aa, Escherichia coli O157:H7 str. EC4045; identical to SEQ ID NO: 11429

SEQ ID NO: 20129 - protein, 241 aa, Escherichia coli O157:H7 str. EC4045; identical to SEQ ID NO: 11431

SEQ ID NO: 20130 - protein, 747 aa, Escherichia coli O157:H7 str. EC4045; identical to SEQ ID NO: 5775

SEQ ID NO: 20131 - protein, 266 aa, Escherichia coli O157:H7 str. EC4045; identical to SEQ ID NO: 5771

SEQ ID NO: 20132 - protein, 828 aa, Escherichia coli O157:H7 str. EC4045; identical to SEQ ID NO: 5735

SEQ ID NO: 20133 - protein, 162 aa, Escherichia coli O157:H7 str. EC4045; identical to SEQ ID NO: 5734

SEQ ID NO: 20134 - protein, 367 aa, Escherichia coli O157:H7 str. EC4045; identical to SEQ ID NO: 5700

SEQ ID NO: 20135 - protein, 161 aa, Escherichia coli O157:H7 str. EC4045; identical to SEQ ID NO: 5769

SEQ ID NO: 20136 - protein, 208 aa, Escherichia coli O157:H7 str. EC4045; identical to SEQ ID NO: 5717

SEQ ID NO: 20137 - protein, 351 aa, Escherichia coli O157:H7 str. EC4045; identical to SEQ ID NO: 5767

SEQ ID NO: 20138 - protein, 200 aa, Escherichia coli O157:H7 str. EC4045; identical to SEQ ID NO: 5733

SEQ ID NO: 20139 - protein, 432 aa, Escherichia coli O157:H7 str. EC4045; identical to SEQ ID NO: 5727

SEQ ID NO: 20140 - protein, 412 aa, Escherichia coli O157:H7 str. EC4045; identical to SEQ ID NO: 5719

SEQ ID NO: 20141 - protein, 274 aa, Escherichia coli O157:H7 str. EC4045; identical to SEQ ID NO: 5731

SEQ ID NO: 20142 - protein, 252 aa, Escherichia coli O157:H7 str. EC4045; identical to SEQ ID NO: 11406

SEQ ID NO: 20143 - protein, 860 aa, Escherichia coli O157:H7 str. EC4045; identical to SEQ ID NO: 11720

SEQ ID NO: 20144 - protein, 614 aa, Escherichia coli O157:H7 str. EC4045; identical to SEQ ID NO: 5715

SEQ ID NO: 20145 - protein, 89 aa, Escherichia coli O157:H7 str. EC4045; identical to SEQ ID NO: 6233

SEQ ID NO: 20146 - protein, 567 aa, Escherichia coli O157:H7 str. EC4045; identical to SEQ ID NO: 11409

SEQ ID NO: 20147 - protein, 446 aa, Escherichia coli O157:H7 str. EC4045; identical to SEQ ID NO: 5714

SEQ ID NO: 20148 - protein, 237 aa, Escherichia coli O157:H7 str. EC4045; identical to SEQ ID NO: 5713

SEQ ID NO: 20149 - protein, 478 aa, Escherichia coli O157:H7 str. EC4045; identical to SEQ ID NO: 5712

SEQ ID NO: 20150 - protein, 660 aa, Escherichia coli O157:H7 str. EC4045; identical to SEQ ID NO: 11731

SEQ ID NO: 20151 - protein, 359 aa, Escherichia coli O157:H7 str. EC4045; identical to SEQ ID NO: 11410

SEQ ID NO: 20152 - protein, 229 aa, Escherichia coli O157:H7 str. EC4045; identical to SEQ ID NO: 11418

SEQ ID NO: 20153 - protein, 826 aa, Escherichia coli O157:H7 str. EC4045; identical to SEQ ID NO: 11397

SEQ ID NO: 20154 - protein, 224 aa, Escherichia coli O157:H7 str. EC4045; identical to SEQ ID NO: 11398

SEQ ID NO: 20155 - protein, 689 aa, Escherichia coli O157:H7 str. EC4045; identical to SEQ ID NO: 11798

SEQ ID NO: 20156 - protein, 368 aa, Escherichia coli O157:H7 str. EC4045; identical to SEQ ID NO: 11425

SEQ ID NO: 20157 - protein, 241 aa, Escherichia coli O157:H7 str. EC4045; identical to SEQ ID NO: 5709

SEQ ID NO: 20158 - protein, 863 aa, Escherichia coli O157:H7 str. EC4045; identical to SEQ ID NO: 11427

SEQ ID NO: 20159 - protein, 331 aa, Escherichia coli O157:H7 str. EC4045; identical to SEQ ID NO: 6551

SEQ ID NO: 20160 - protein, 760 aa, Escherichia coli O157:H7 str. EC4045; identical to SEQ ID NO: 5756

SEQ ID NO: 20161 - protein, 203 aa, Escherichia coli O157:H7 str. EC4045; identical to SEQ ID NO: 6414

SEQ ID NO: 20162 - protein, 362 aa, Escherichia coli O157:H7 str. EC4045; identical to SEQ ID NO: 5754

SEQ ID NO: 20163 - protein, 224 aa, Escherichia coli O157:H7 str. EC4045; identical to SEQ ID NO: 11374

SEQ ID NO: 20164 - protein, 539 aa, Escherichia coli O157:H7 str. EC4045; identical to SEQ ID NO: 6525

SEQ ID NO: 20165 - protein, 700 aa, Escherichia coli O157:H7 str. EC4045; identical to SEQ ID NO: 5740

SEQ ID NO: 20166 - protein, 366 aa, Escherichia coli O157:H7 str. EC4045; identical to SEQ ID NO: 11362

SEQ ID NO: 20167 - protein, 883 aa, Escherichia coli O157:H7 str. EC4045; identical to SEQ ID NO: 5702

SEQ ID NO: 20168 - protein, 236 aa, Escherichia coli O157:H7 str. EC4045; identical to SEQ ID NO: 11364

SEQ ID NO: 20169 - protein, 229 aa, Escherichia coli O157:H7 str. EC4045; identical to SEQ ID NO: 11455

SEQ ID NO: 20170 - protein, 233 aa, Escherichia coli O157:H7 str. EC4045; identical to SEQ ID NO: 11381

SEQ ID NO: 20171 - protein, 696 aa, Escherichia coli O157:H7 str. EC4045; identical to SEQ ID NO: 6320

SEQ ID NO: 20172 - protein, 517 aa, Escherichia coli O157:H7 str. EC4045; identical to SEQ ID NO: 6817

SEQ ID NO: 20173 - protein, 191 aa, Escherichia coli O157:H7 str. EC4045; identical to SEQ ID NO: 5748

SEQ ID NO: 20174 - protein, 232 aa, Escherichia coli O157:H7 str. EC4045; identical to SEQ ID NO: 5747

SEQ ID NO: 20175 - protein, 729 aa, Escherichia coli O157:H7 str. EC4045; identical to SEQ ID NO: 5745

SEQ ID NO: 20176 - protein, 213 aa, Escherichia coli O157:H7 str. EC4045; identical to SEQ ID NO: 5744

SEQ ID NO: 20177 - protein, 230 aa, Escherichia coli O157:H7 str. EC4045; identical to SEQ ID NO: 5765

SEQ ID NO: 20178 - protein, 869 aa, Escherichia coli O157:H7 str. EC4045; identical to SEQ ID NO: 5763

SEQ ID NO: 20179 - protein, 746 aa, Escherichia coli O157:H7 str. EC4045; identical to SEQ ID NO: 5761

SEQ ID NO: 20180 - protein, 193 aa, Escherichia coli O157:H7 str. EC4045; identical to SEQ ID NO: 5760

SEQ ID NO: 20181 - protein, 203 aa, Escherichia coli O157:H7 str. EC4045; identical to SEQ ID NO: 6347

SEQ ID NO: 20182 - protein, 243 aa, Escherichia coli O157:H7 str. EC4045; identical to SEQ ID NO: 11367

SEQ ID NO: 20183 - protein, 816 aa, Escherichia coli O157:H7 str. EC4045; identical to SEQ ID NO: 11682

SEQ ID NO: 20184 - protein, 430 aa, Escherichia coli O157:H7 str. EC4045; identical to SEQ ID NO: 5758

SEQ ID NO: 20185 - protein, 207 aa, Escherichia coli O157:H7 str. EC4045; identical to SEQ ID NO: 5743

SEQ ID NO: 20186 - protein, 715 aa, Escherichia coli O157:H7 str. EC4045; identical to SEQ ID NO: 11710

SEQ ID NO: 20187 - protein, 111 aa, Escherichia coli O157:H7 str. EC4045; identical to SEQ ID NO: 5738

SEQ ID NO: 20188 - protein, 122 aa, Escherichia coli O157:H7 str. EC4045; identical to SEQ ID NO: 5737

SEQ ID NO: 20189 - protein, 89 aa, Escherichia coli O157:H7 str. EC4045; identical to SEQ ID NO: 6053

SEQ ID NO: 20190 - protein, 655 aa, Escherichia coli O157:H7 str. EC4045; identical to SEQ ID NO: 11466

SEQ ID NO: 20191 - protein, 998 aa, Escherichia coli O157:H7 str. EC4045; identical to SEQ ID NO: 5657

SEQ ID NO: 20192 - protein, 518 aa, Escherichia coli O157:H7 str. EC4076; identical to SEQ ID NO: 11400

SEQ ID NO: 20193 - protein, 567 aa, Escherichia coli O157:H7 str. EC4076; identical to SEQ ID NO: 11409

SEQ ID NO: 20194 - protein, 432 aa, Escherichia coli O157:H7 str. EC4076; identical to SEQ ID NO: 5727

SEQ ID NO: 20195 - protein, 230 aa, Escherichia coli O157:H7 str. EC4076; identical to SEQ ID NO: 5765

SEQ ID NO: 20196 - protein, 869 aa, Escherichia coli O157:H7 str. EC4076; identical to SEQ ID NO: 5763

SEQ ID NO: 20197 - protein, 746 aa, Escherichia coli O157:H7 str. EC4076; identical to SEQ ID NO: 5761

SEQ ID NO: 20198 - protein, 193 aa, Escherichia coli O157:H7 str. EC4076; identical to SEQ ID NO: 5760

SEQ ID NO: 20199 - protein, 243 aa, Escherichia coli O157:H7 str. EC4076; identical to SEQ ID NO: 11367

SEQ ID NO: 20200 - protein, 816 aa, Escherichia coli O157:H7 str. EC4076; identical to SEQ ID NO: 11682

SEQ ID NO: 20201 - protein, 430 aa, Escherichia coli O157:H7 str. EC4076; identical to SEQ ID NO: 5758

SEQ ID NO: 20202 - protein, 331 aa, Escherichia coli O157:H7 str. EC4076; identical to SEQ ID NO: 6551

SEQ ID NO: 20203 - protein, 760 aa, Escherichia coli O157:H7 str. EC4076; identical to SEQ ID NO: 5756

SEQ ID NO: 20204 - protein, 412 aa, Escherichia coli O157:H7 str. EC4076; identical to SEQ ID NO: 5719

SEQ ID NO: 20205 - protein, 660 aa, Escherichia coli O157:H7 str. EC4076; identical to SEQ ID NO: 11731

SEQ ID NO: 20206 - protein, 229 aa, Escherichia coli O157:H7 str. EC4076; identical to SEQ ID NO: 11418

SEQ ID NO: 20207 - protein, 512 aa, Escherichia coli O157:H7 str. EC4076; identical to SEQ ID NO: 5948

SEQ ID NO: 20208 - protein, 659 aa, Escherichia coli O157:H7 str. EC4076; identical to SEQ ID NO: 5736

SEQ ID NO: 20209 - protein, 828 aa, Escherichia coli O157:H7 str. EC4076; identical to SEQ ID NO: 5735

SEQ ID NO: 20210 - protein, 162 aa, Escherichia coli O157:H7 str. EC4076; identical to SEQ ID NO: 5734

SEQ ID NO: 20211 - protein, 367 aa, Escherichia coli O157:H7 str. EC4076; identical to SEQ ID NO: 5700

SEQ ID NO: 20212 - protein, 200 aa, Escherichia coli O157:H7 str. EC4076; identical to SEQ ID NO: 5733

SEQ ID NO: 20213 - protein, 274 aa, Escherichia coli O157:H7 str. EC4076; identical to SEQ ID NO: 5731

SEQ ID NO: 20214 - protein, 252 aa, Escherichia coli O157:H7 str. EC4076; identical to SEQ ID NO: 11406

SEQ ID NO: 20215 - protein, 879 aa, Escherichia coli O157:H7 str. EC4076; identical to SEQ ID NO: 19287

SEQ ID NO: 20216 - protein, 89 aa, Escherichia coli O157:H7 str. EC4076; identical to SEQ ID NO: 6233

SEQ ID NO: 20217 - protein, 446 aa, Escherichia coli O157:H7 str. EC4076; identical to SEQ ID NO: 5714

SEQ ID NO: 20218 - protein, 237 aa, Escherichia coli O157:H7 str. EC4076; identical to SEQ ID NO: 5713

SEQ ID NO: 20219 - protein, 478 aa, Escherichia coli O157:H7 str. EC4076; identical to SEQ ID NO: 5712

SEQ ID NO: 20220 - protein, 614 aa, Escherichia coli O157:H7 str. EC4076; identical to SEQ ID NO: 5715

SEQ ID NO: 20221 - protein, 208 aa, Escherichia coli O157:H7 str. EC4076; identical to SEQ ID NO: 5717

SEQ ID NO: 20222 - protein, 229 aa, Escherichia coli O157:H7 str. EC4076; identical to SEQ ID NO: 11455

SEQ ID NO: 20223 - protein, 233 aa, Escherichia coli O157:H7 str. EC4076; identical to SEQ ID NO: 11381

SEQ ID NO: 20224 - protein, 696 aa, Escherichia coli O157:H7 str. EC4076; identical to SEQ ID NO: 6320

SEQ ID NO: 20225 - protein, 231 aa, Escherichia coli O157:H7 str. EC4076; identical to SEQ ID NO: 5724

SEQ ID NO: 20226 - protein, 863 aa, Escherichia coli O157:H7 str. EC4076; identical to SEQ ID NO: 19681

SEQ ID NO: 20227 - protein, 678 aa, Escherichia coli O157:H7 str. EC4076; identical to SEQ ID NO: 5722

SEQ ID NO: 20228 - protein, 700 aa, Escherichia coli O157:H7 str. EC4076; identical to SEQ ID NO: 5740

SEQ ID NO: 20229 - protein, 366 aa, Escherichia coli O157:H7 str. EC4076; identical to SEQ ID NO: 11362

SEQ ID NO: 20230 - protein, 871 aa, Escherichia coli O157:H7 str. EC4076; identical to SEQ ID NO: 11363

SEQ ID NO: 20231 - protein, 236 aa, Escherichia coli O157:H7 str. EC4076; identical to SEQ ID NO: 11364

SEQ ID NO: 20232 - protein, 227 aa, Escherichia coli O157:H7 str. EC4076; identical to SEQ ID NO: 11429

SEQ ID NO: 20233 - protein, 359 aa, Escherichia coli O157:H7 str. EC4076; identical to SEQ ID NO: 11410

SEQ ID NO: 20234 - protein, 713 aa, Escherichia coli O157:H7 str. EC4076; identical to SEQ ID NO: 11726

SEQ ID NO: 20235 - protein, 241 aa, Escherichia coli O157:H7 str. EC4076; identical to SEQ ID NO: 11431

SEQ ID NO: 20236 - protein, 747 aa, Escherichia coli O157:H7 str. EC4076; identical to SEQ ID NO: 5775

SEQ ID NO: 20237 - protein, 266 aa, Escherichia coli O157:H7 str. EC4076; identical to SEQ ID NO: 5771

SEQ ID NO: 20238 - protein, 161 aa, Escherichia coli O157:H7 str. EC4076; identical to SEQ ID NO: 5769

SEQ ID NO: 20239 - protein, 203 aa, Escherichia coli O157:H7 str. EC4076; identical to SEQ ID NO: 6347

SEQ ID NO: 20240 - protein, 207 aa, Escherichia coli O157:H7 str. EC4076; identical to SEQ ID NO: 5743

SEQ ID NO: 20241 - protein, 368 aa, Escherichia coli O157:H7 str. EC4076; identical to SEQ ID NO: 11425

SEQ ID NO: 20242 - protein, 241 aa, Escherichia coli O157:H7 str. EC4076; identical to SEQ ID NO: 5709

SEQ ID NO: 20243 - protein, 539 aa, Escherichia coli O157:H7 str. EC4076; identical to SEQ ID NO: 6525

SEQ ID NO: 20244 - protein, 351 aa, Escherichia coli O157:H7 str. EC4076; identical to SEQ ID NO: 5767

SEQ ID NO: 20245 - protein, 998 aa, Escherichia coli O157:H7 str. EC4076; identical to SEQ ID NO: 5657

SEQ ID NO: 20246 - protein, 650 aa, Escherichia coli O157:H7 str. EC4076; identical to SEQ ID NO: 11539

SEQ ID NO: 20247 - protein, 122 aa, Escherichia coli O157:H7 str. EC4076; identical to SEQ ID NO: 5737

SEQ ID NO: 20248 - protein, 111 aa, Escherichia coli O157:H7 str. EC4076; identical to SEQ ID NO: 5738

SEQ ID NO: 20249 - protein, 729 aa, Escherichia coli O157:H7 str. EC4076; identical to SEQ ID NO: 5745

SEQ ID NO: 20250 - protein, 213 aa, Escherichia coli O157:H7 str. EC4076; identical to SEQ ID NO: 5744

SEQ ID NO: 20251 - protein, 517 aa, Escherichia coli O157:H7 str. EC4076; identical to SEQ ID NO: 6817

SEQ ID NO: 20252 - protein, 191 aa, Escherichia coli O157:H7 str. EC4076; identical to SEQ ID NO: 5748

SEQ ID NO: 20253 - protein, 232 aa, Escherichia coli O157:H7 str. EC4076; identical to SEQ ID NO: 5747

SEQ ID NO: 20254 - protein, 203 aa, Escherichia coli O157:H7 str. EC4076; identical to SEQ ID NO: 6414

SEQ ID NO: 20255 - protein, 826 aa, Escherichia coli O157:H7 str. EC4076; identical to SEQ ID NO: 11397

SEQ ID NO: 20256 - protein, 224 aa, Escherichia coli O157:H7 str. EC4076; identical to SEQ ID NO: 11398

SEQ ID NO: 20257 - protein, 224 aa, Escherichia coli O157:H7 str. EC4076; identical to SEQ ID NO: 11374

SEQ ID NO: 20258 - protein, 362 aa, Escherichia coli O157:H7 str. EC4076; identical to SEQ ID NO: 5754

SEQ ID NO: 20259 - protein, 715 aa, Escherichia coli O157:H7 str. EC4076; identical to SEQ ID NO: 11710

SEQ ID NO: 20260 - protein, 89 aa, Escherichia coli O157:H7 str. EC4076; identical to SEQ ID NO: 6053

SEQ ID NO: 20261 - protein, 859 aa, Escherichia coli O157:H7 str. EC4076
MWNLLRRTRKNQKSGRDVREAGWTSLFQAVAEPFSGAWQQGLKADPEAVLSFHAVFACISLISQDIAKMRLRLMQTDAHGIRRETRRGDIARLCRRPHAQQNLIQFFELWLNAKLRHGNTVVLKIRNARGQIKELRILDWSRVEPLVADDGEVFYRITPDRNCGITEAVTVPAREVIHDRFNCFFHPLIGLPPVYAAGLAATQGHHIQENSTSFFRNGGRPSGVIEIPGSITEENAKKLKSNWDSGYTGENAGKTAILSNGAKYNPTTFSPVDAQTVEQLKMTAEIVCSVFRVPAYKIGVGQPPSSDNVEALEQQYYSQCLQTLIESIELLLDEALETGENESTEFDVTTLLRMDSERRMKTLGDAVKNTLLTPNEARKRENLPPLAGGDALYLQQQNYSLEALSRRDAREDPFASAGKTVSSQLPDGASDGNKAISETEHDAVKAMFRGDTEKMTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 20262 - protein, 229 aa, Escherichia coli O157:H7 str. EC4113; identical to SEQ ID NO: 11418

SEQ ID NO: 20263 - protein, 660 aa, Escherichia coli O157:H7 str. EC4113; identical to SEQ ID NO: 11731

SEQ ID NO: 20264 - protein, 412 aa, Escherichia coli O157:H7 str. EC4113; identical to SEQ ID NO: 5719

SEQ ID NO: 20265 - protein, 232 aa, Escherichia coli O157:H7 str. EC4113; identical to SEQ ID NO: 5747

SEQ ID NO: 20266 - protein, 191 aa, Escherichia coli O157:H7 str. EC4113; identical to SEQ ID NO: 5748

SEQ ID NO: 20267 - protein, 517 aa, Escherichia coli O157:H7 str. EC4113; identical to SEQ ID NO: 6817

SEQ ID NO: 20268 - protein, 696 aa, Escherichia coli O157:H7 str. EC4113; identical to SEQ ID NO: 6320

SEQ ID NO: 20269 - protein, 233 aa, Escherichia coli O157:H7 str. EC4113; identical to SEQ ID NO: 11381

SEQ ID NO: 20270 - protein, 229 aa, Escherichia coli O157:H7 str. EC4113; identical to SEQ ID NO: 11455

SEQ ID NO: 20271 - protein, 713 aa, Escherichia coli O157:H7 str. EC4113; identical to SEQ ID NO: 11726

SEQ ID NO: 20272 - protein, 359 aa, Escherichia coli O157:H7 str. EC4113; identical to SEQ ID NO: 11410

SEQ ID NO: 20273 - protein, 567 aa, Escherichia coli O157:H7 str. EC4113; identical to SEQ ID NO: 11409

SEQ ID NO: 20274 - protein, 746 aa, Escherichia coli O157:H7 str. EC4113; identical to SEQ ID NO: 5761

SEQ ID NO: 20275 - protein, 869 aa, Escherichia coli O157:H7 str. EC4113; identical to SEQ ID NO: 5763

SEQ ID NO: 20276 - protein, 230 aa, Escherichia coli O157:H7 str. EC4113; identical to SEQ ID NO: 5765

SEQ ID NO: 20277 - protein, 478 aa, Escherichia coli O157:H7 str. EC4113; identical to SEQ ID NO: 5712

SEQ ID NO: 20278 - protein, 237 aa, Escherichia coli O157:H7 str. EC4113; identical to SEQ ID NO: 5713

SEQ ID NO: 20279 - protein, 274 aa, Escherichia coli O157:H7 str. EC4113; identical to SEQ ID NO: 5731

SEQ ID NO: 20280 - protein, 252 aa, Escherichia coli O157:H7 str. EC4113; identical to SEQ ID NO: 11406

SEQ ID NO: 20281 - protein, 860 aa, Escherichia coli O157:H7 str. EC4113; identical to SEQ ID NO: 11720

SEQ ID NO: 20282 - protein, 89 aa, Escherichia coli O157:H7 str. EC4113; identical to SEQ ID NO: 6233

SEQ ID NO: 20283 - protein, 518 aa, Escherichia coli O157:H7 str. EC4113; identical to SEQ ID NO: 11400

SEQ ID NO: 20284 - protein, 512 aa, Escherichia coli O157:H7 str. EC4113; identical to SEQ ID NO: 5948

SEQ ID NO: 20285 - protein, 614 aa, Escherichia coli O157:H7 str. EC4113; identical to SEQ ID NO: 5715

SEQ ID NO: 20286 - protein, 236 aa, Escherichia coli O157:H7 str. EC4113; identical to SEQ ID NO: 11364

SEQ ID NO: 20287 - protein, 871 aa, Escherichia coli O157:H7 str. EC4113; identical to SEQ ID NO: 11363

SEQ ID NO: 20288 - protein, 366 aa, Escherichia coli O157:H7 str. EC4113; identical to SEQ ID NO: 11362

SEQ ID NO: 20289 - protein, 700 aa, Escherichia coli O157:H7 str. EC4113; identical to SEQ ID NO: 5740

SEQ ID NO: 20290 - protein, 539 aa, Escherichia coli O157:H7 str. EC4113; identical to SEQ ID NO: 6525

SEQ ID NO: 20291 - protein, 678 aa, Escherichia coli O157:H7 str. EC4113; identical to SEQ ID NO: 5722

SEQ ID NO: 20292 - protein, 863 aa, Escherichia coli O157:H7 str. EC4113; identical to SEQ ID NO: 19681

SEQ ID NO: 20293 - protein, 231 aa, Escherichia coli O157:H7 str. EC4113; identical to SEQ ID NO: 5724

SEQ ID NO: 20294 - protein, 863 aa, Escherichia coli O157:H7 str. EC4113; identical to SEQ ID NO: 11427

SEQ ID NO: 20295 - protein, 241 aa, Escherichia coli O157:H7 str. EC4113; identical to SEQ ID NO: 5709

SEQ ID NO: 20296 - protein, 368 aa, Escherichia coli O157:H7 str. EC4113; identical to SEQ ID NO: 11425

SEQ ID NO: 20297 - protein, 828 aa, Escherichia coli O157:H7 str. EC4113; identical to SEQ ID NO: 5735

SEQ ID NO: 20298 - protein, 162 aa, Escherichia coli O157:H7 str. EC4113; identical to SEQ ID NO: 5734

SEQ ID NO: 20299 - protein, 367 aa, Escherichia coli O157:H7 str. EC4113; identical to SEQ ID NO: 5700

SEQ ID NO: 20300 - protein, 200 aa, Escherichia coli O157:H7 str. EC4113; identical to SEQ ID NO: 5733

SEQ ID NO: 20301 - protein, 240 aa, Escherichia coli O157:H7 str. EC4113; identical to SEQ ID NO: 19813

SEQ ID NO: 20302 - protein, 826 aa, Escherichia coli O157:H7 str. EC4113; identical to SEQ ID NO: 11397

SEQ ID NO: 20303 - protein, 351 aa, Escherichia coli O157:H7 str. EC4113; identical to SEQ ID NO: 5767

SEQ ID NO: 20304 - protein, 208 aa, Escherichia coli O157:H7 str. EC4113; identical to SEQ ID NO: 5717

SEQ ID NO: 20305 - protein, 659 aa, Escherichia coli O157:H7 str. EC4113; identical to SEQ ID NO: 5736

SEQ ID NO: 20306 - protein, 111 aa, Escherichia coli O157:H7 str. EC4113; identical to SEQ ID NO: 5738

SEQ ID NO: 20307 - protein, 243 aa, Escherichia coli O157:H7 str. EC4113; identical to SEQ ID NO: 11367

SEQ ID NO: 20308 - protein, 816 aa, Escherichia coli O157:H7 str. EC4113; identical to SEQ ID NO: 11682

SEQ ID NO: 20309 - protein, 650 aa, Escherichia coli O157:H7 str. EC4113; identical to SEQ ID NO: 11539

SEQ ID NO: 20310 - protein, 998 aa, Escherichia coli O157:H7 str. EC4113; identical to SEQ ID NO: 5657

SEQ ID NO: 20311 - protein, 203 aa, Escherichia coli O157:H7 str. EC4113; identical to SEQ ID NO: 6347

SEQ ID NO: 20312 - protein, 207 aa, Escherichia coli O157:H7 str. EC4113; identical to SEQ ID NO: 5743

SEQ ID NO: 20313 - protein, 446 aa, Escherichia coli O157:H7 str. EC4113; identical to SEQ ID NO: 5714

SEQ ID NO: 20314 - protein, 227 aa, Escherichia coli O157:H7 str. EC4113; identical to SEQ ID NO: 11429

SEQ ID NO: 20315 - protein, 362 aa, Escherichia coli O157:H7 str. EC4113; identical to SEQ ID NO: 5754

SEQ ID NO: 20316 - protein, 224 aa, Escherichia coli O157:H7 str. EC4113; identical to SEQ ID NO: 11374

SEQ ID NO: 20317 - protein, 213 aa, Escherichia coli O157:H7 str. EC4113; identical to SEQ ID NO: 5744

SEQ ID NO: 20318 - protein, 729 aa, Escherichia coli O157:H7 str. EC4113; identical to SEQ ID NO: 5745

SEQ ID NO: 20319 - protein, 241 aa, Escherichia coli O157:H7 str. EC4113; identical to SEQ ID NO: 11431

SEQ ID NO: 20320 - protein, 266 aa, Escherichia coli O157:H7 str. EC4113; identical to SEQ ID NO: 5771

SEQ ID NO: 20321 - protein, 859 aa, Escherichia coli O157:H7 str. EC4113; identical to SEQ ID NO: 19736

SEQ ID NO: 20322 - protein, 715 aa, Escherichia coli O157:H7 str. EC4113; identical to SEQ ID NO: 11710

SEQ ID NO: 20323 - protein, 331 aa, Escherichia coli O157:H7 str. EC4113; identical to SEQ ID NO: 6551

SEQ ID NO: 20324 - protein, 122 aa, Escherichia coli O157:H7 str. EC4113; identical to SEQ ID NO: 5737

SEQ ID NO: 20325 - protein, 203 aa, Escherichia coli O157:H7 str. EC4113; identical to SEQ ID NO: 6414

SEQ ID NO: 20326 - protein, 161 aa, Escherichia coli O157:H7 str. EC4113; identical to SEQ ID NO: 5769

SEQ ID NO: 20327 - protein, 89 aa, Escherichia coli O157:H7 str. EC4113; identical to SEQ ID NO: 6053

SEQ ID NO: 20328 - protein, 193 aa, Escherichia coli O157:H7 str. EC4113; identical to SEQ ID NO: 5760

SEQ ID NO: 20329 - protein, 432 aa, Escherichia coli O157:H7 str. EC4113; identical to SEQ ID NO: 5727

SEQ ID NO: 20330 - protein, 512 aa, Escherichia coli O157:H7 str. EC4196; identical to SEQ ID NO: 5948

SEQ ID NO: 20331 - protein, 229 aa, Escherichia coli O157:H7 str. EC4196; identical to SEQ ID NO: 11418

SEQ ID NO: 20332 - protein, 660 aa, Escherichia coli O157:H7 str. EC4196; identical to SEQ ID NO: 11731

SEQ ID NO: 20333 - protein, 412 aa, Escherichia coli O157:H7 str. EC4196; identical to SEQ ID NO: 5719

SEQ ID NO: 20334 - protein, 200 aa, Escherichia coli O157:H7 str. EC4196; identical to SEQ ID NO: 5733

SEQ ID NO: 20335 - protein, 367 aa, Escherichia coli O157:H7 str. EC4196; identical to SEQ ID NO: 5700

SEQ ID NO: 20336 - protein, 162 aa, Escherichia coli O157:H7 str. EC4196; identical to SEQ ID NO: 5734

SEQ ID NO: 20337 - protein, 828 aa, Escherichia coli O157:H7 str. EC4196; identical to SEQ ID NO: 5735

SEQ ID NO: 20338 - protein, 659 aa, Escherichia coli O157:H7 str. EC4196; identical to SEQ ID NO: 5736

SEQ ID NO: 20339 - protein, 89 aa, Escherichia coli O157:H7 str. EC4196; identical to SEQ ID NO: 6233

SEQ ID NO: 20340 - protein, 860 aa, Escherichia coli O157:H7 str. EC4196; identical to SEQ ID NO: 11720

SEQ ID NO: 20341 - protein, 252 aa, Escherichia coli O157:H7 str. EC4196; identical to SEQ ID NO: 11406

SEQ ID NO: 20342 - protein, 274 aa, Escherichia coli O157:H7 str. EC4196; identical to SEQ ID NO: 5731

SEQ ID NO: 20343 - protein, 678 aa, Escherichia coli O157:H7 str. EC4196; identical to SEQ ID NO: 5722

SEQ ID NO: 20344 - protein, 863 aa, Escherichia coli O157:H7 str. EC4196; identical to SEQ ID NO: 19681

SEQ ID NO: 20345 - protein, 231 aa, Escherichia coli O157:H7 str. EC4196; identical to SEQ ID NO: 5724

SEQ ID NO: 20346 - protein, 713 aa, Escherichia coli O157:H7 str. EC4196; identical to SEQ ID NO: 11726

SEQ ID NO: 20347 - protein, 359 aa, Escherichia coli O157:H7 str. EC4196; identical to SEQ ID NO: 11410

SEQ ID NO: 20348 - protein, 518 aa, Escherichia coli O157:H7 str. EC4196; identical to SEQ ID NO: 11400

SEQ ID NO: 20349 - protein, 229 aa, Escherichia coli O157:H7 str. EC4196; identical to SEQ ID NO: 11455

SEQ ID NO: 20350 - protein, 233 aa, Escherichia coli O157:H7 str. EC4196; identical to SEQ ID NO: 11381

SEQ ID NO: 20351 - protein, 696 aa, Escherichia coli O157:H7 str. EC4196; identical to SEQ ID NO: 6320

SEQ ID NO: 20352 - protein, 517 aa, Escherichia coli O157:H7 str. EC4196; identical to SEQ ID NO: 6817

SEQ ID NO: 20353 - protein, 191 aa, Escherichia coli O157:H7 str. EC4196; identical to SEQ ID NO: 5748

SEQ ID NO: 20354 - protein, 232 aa, Escherichia coli O157:H7 str. EC4196; identical to SEQ ID NO: 5747

SEQ ID NO: 20355 - protein, 863 aa, Escherichia coli O157:H7 str. EC4196; identical to SEQ ID NO: 11427

SEQ ID NO: 20356 - protein, 241 aa, Escherichia coli O157:H7 str. EC4196; identical to SEQ ID NO: 5709

SEQ ID NO: 20357 - protein, 368 aa, Escherichia coli O157:H7 str. EC4196; identical to SEQ ID NO: 11425

SEQ ID NO: 20358 - protein, 236 aa, Escherichia coli O157:H7 str. EC4196; identical to SEQ ID NO: 11364

SEQ ID NO: 20359 - protein, 871 aa, Escherichia coli O157:H7 str. EC4196; identical to SEQ ID NO: 11363

SEQ ID NO: 20360 - protein, 366 aa, Escherichia coli O157:H7 str. EC4196; identical to SEQ ID NO: 11362

SEQ ID NO: 20361 - protein, 700 aa, Escherichia coli O157:H7 str. EC4196; identical to SEQ ID NO: 5740

SEQ ID NO: 20362 - protein, 446 aa, Escherichia coli O157:H7 str. EC4196; identical to SEQ ID NO: 5714

SEQ ID NO: 20363 - protein, 237 aa, Escherichia coli O157:H7 str. EC4196; identical to SEQ ID NO: 5713

SEQ ID NO: 20364 - protein, 478 aa, Escherichia coli O157:H7 str. EC4196; identical to SEQ ID NO: 5712

SEQ ID NO: 20365 - protein, 230 aa, Escherichia coli O157:H7 str. EC4196; identical to SEQ ID NO: 5765

SEQ ID NO: 20366 - protein, 869 aa, Escherichia coli O157:H7 str. EC4196; identical to SEQ ID NO: 5763

SEQ ID NO: 20367 - protein, 746 aa, Escherichia coli O157:H7 str. EC4196; identical to SEQ ID NO: 5761

SEQ ID NO: 20368 - protein, 614 aa, Escherichia coli O157:H7 str. EC4196; identical to SEQ ID NO: 5715

SEQ ID NO: 20369 - protein, 208 aa, Escherichia coli O157:H7 str. EC4196; identical to SEQ ID NO: 5717

SEQ ID NO: 20370 - protein, 567 aa, Escherichia coli O157:H7 str. EC4196; identical to SEQ ID NO: 11409

SEQ ID NO: 20371 - protein, 111 aa, Escherichia coli O157:H7 str. EC4196; identical to SEQ ID NO: 5738

SEQ ID NO: 20372 - protein, 224 aa, Escherichia coli O157:H7 str. EC4196; identical to SEQ ID NO: 11398

SEQ ID NO: 20373 - protein, 826 aa, Escherichia coli O157:H7 str. EC4196; identical to SEQ ID NO: 11397

SEQ ID NO: 20374 - protein, 351 aa, Escherichia coli O157:H7 str. EC4196; identical to SEQ ID NO: 5767

SEQ ID NO: 20375 - protein, 224 aa, Escherichia coli O157:H7 str. EC4196; identical to SEQ ID NO: 11374

SEQ ID NO: 20376 - protein, 362 aa, Escherichia coli O157:H7 str. EC4196; identical to SEQ ID NO: 5754

SEQ ID NO: 20377 - protein, 203 aa, Escherichia coli O157:H7 str. EC4196; identical to SEQ ID NO: 6414

SEQ ID NO: 20378 - protein, 227 aa, Escherichia coli O157:H7 str. EC4196; identical to SEQ ID NO: 11429

SEQ ID NO: 20379 - protein, 650 aa, Escherichia coli O157:H7 str. EC4196; identical to SEQ ID NO: 11539

SEQ ID NO: 20380 - protein, 998 aa, Escherichia coli O157:H7 str. EC4196; identical to SEQ ID NO: 5657

SEQ ID NO: 20381 - protein, 213 aa, Escherichia coli O157:H7 str. EC4196; identical to SEQ ID NO: 5744

SEQ ID NO: 20382 - protein, 729 aa, Escherichia coli O157:H7 str. EC4196; identical to SEQ ID NO: 5745

SEQ ID NO: 20383 - protein, 241 aa, Escherichia coli O157:H7 str. EC4196; identical to SEQ ID NO: 11431

SEQ ID NO: 20384 - protein, 207 aa, Escherichia coli O157:H7 str. EC4196; identical to SEQ ID NO: 5743

SEQ ID NO: 20385 - protein, 784 aa, Escherichia coli O157:H7 str. EC4196
MKKRIPTLLATMIATALYSQQGLAADLASHCMLGVPSYDRPLVQGDTNDLPVTINANHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVSIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 20386 - protein, 747 aa, Escherichia coli O157:H7 str. EC4196; identical to SEQ ID NO: 5775

SEQ ID NO: 20387 - protein, 266 aa, Escherichia coli O157:H7 str. EC4196; identical to SEQ ID NO: 5771

SEQ ID NO: 20388 - protein, 243 aa, Escherichia coli O157:H7 str. EC4196; identical to SEQ ID NO: 11367

SEQ ID NO: 20389 - protein, 816 aa, Escherichia coli O157:H7 str. EC4196; identical to SEQ ID NO: 11682

SEQ ID NO: 20390 - protein, 715 aa, Escherichia coli O157:H7 str. EC4196; identical to SEQ ID NO: 11710

SEQ ID NO: 20391 - protein, 539 aa, Escherichia coli O157:H7 str. EC4196; identical to SEQ ID NO: 6525

SEQ ID NO: 20392 - protein, 760 aa, Escherichia coli O157:H7 str. EC4196; identical to SEQ ID NO: 5756

SEQ ID NO: 20393 - protein, 331 aa, Escherichia coli O157:H7 str. EC4196; identical to SEQ ID NO: 6551

SEQ ID NO: 20394 - protein, 193 aa, Escherichia coli O157:H7 str. EC4196; identical to SEQ ID NO: 5760

SEQ ID NO: 20395 - protein, 122 aa, Escherichia coli O157:H7 str. EC4196; identical to SEQ ID NO: 5737

SEQ ID NO: 20396 - protein, 203 aa, Escherichia coli O157:H7 str. EC4196; identical to SEQ ID NO: 6347

SEQ ID NO: 20397 - protein, 432 aa, Escherichia coli O157:H7 str. EC4196; identical to SEQ ID NO: 5727

SEQ ID NO: 20398 - protein, 518 aa, Escherichia coli O157:H7 str. EC4206; identical to SEQ ID NO: 11400

SEQ ID NO: 20399 - protein, 512 aa, Escherichia coli O157:H7 str. EC4206; identical to SEQ ID NO: 5948

SEQ ID NO: 20400 - protein, 224 aa, Escherichia coli O157:H7 str. EC4206; identical to SEQ ID NO: 11649

SEQ ID NO: 20401 - protein, 838 aa, Escherichia coli O157:H7 str. EC4206; identical to SEQ ID NO: 5723

SEQ ID NO: 20402 - protein, 678 aa, Escherichia coli O157:H7 str. EC4206; identical to SEQ ID NO: 5722

SEQ ID NO: 20403 - protein, 227 aa, Escherichia coli O157:H7 str. EC4206; identical to SEQ ID NO: 11429

SEQ ID NO: 20404 - protein, 331 aa, Escherichia coli O157:H7 str. EC4206; identical to SEQ ID NO: 6551

SEQ ID NO: 20405 - protein, 826 aa, Escherichia coli O157:H7 str. EC4206; identical to SEQ ID NO: 11397

SEQ ID NO: 20406 - protein, 224 aa, Escherichia coli O157:H7 str. EC4206; identical to SEQ ID NO: 11398

SEQ ID NO: 20407 - protein, 659 aa, Escherichia coli O157:H7 str. EC4206; identical to SEQ ID NO: 5736

SEQ ID NO: 20408 - protein, 241 aa, Escherichia coli O157:H7 str. EC4206; identical to SEQ ID NO: 11431

SEQ ID NO: 20409 - protein, 747 aa, Escherichia coli O157:H7 str. EC4206; identical to SEQ ID NO: 5775

SEQ ID NO: 20410 - protein, 266 aa, Escherichia coli O157:H7 str. EC4206; identical to SEQ ID NO: 5771

SEQ ID NO: 20411 - protein, 828 aa, Escherichia coli O157:H7 str. EC4206; identical to SEQ ID NO: 5735

SEQ ID NO: 20412 - protein, 162 aa, Escherichia coli O157:H7 str. EC4206; identical to SEQ ID NO: 5734

SEQ ID NO: 20413 - protein, 367 aa, Escherichia coli O157:H7 str. EC4206; identical to SEQ ID NO: 5700

SEQ ID NO: 20414 - protein, 224 aa, Escherichia coli O157:H7 str. EC4206; identical to SEQ ID NO: 11374

SEQ ID NO: 20415 - protein, 200 aa, Escherichia coli O157:H7 str. EC4206; identical to SEQ ID NO: 5733

SEQ ID NO: 20416 - protein, 208 aa, Escherichia coli O157:H7 str. EC4206; identical to SEQ ID NO: 5717

SEQ ID NO: 20417 - protein, 351 aa, Escherichia coli O157:H7 str. EC4206; identical to SEQ ID NO: 5767

SEQ ID NO: 20418 - protein, 432 aa, Escherichia coli O157:H7 str. EC4206; identical to SEQ ID NO: 5727

SEQ ID NO: 20419 - protein, 412 aa, Escherichia coli O157:H7 str. EC4206; identical to SEQ ID NO: 5719

SEQ ID NO: 20420 - protein, 229 aa, Escherichia coli O157:H7 str. EC4206; identical to SEQ ID NO: 11455

SEQ ID NO: 20421 - protein, 234 aa, Escherichia coli O157:H7 str. EC4206
MNIFAYLLVLVFSMSMSSSAFASVVMTGTRIIFPGDAKGKKTIQLRNTSDQPYIINIHVEDERGSDKNVPFMPTPQTFRMEAAAGQALRLLYTGNNLPQDRESVFWFSFSQLPYLNKNDKSQNQLILALTNRVKIFYRPSSIVGKSSDAPKNLTYQVKQNRIEVTNPTGYYVTIRAAELLNNGKKVPLANSVMIAPQSTTEWTLPSGISVAPGAQIHLVTVNDYGVNVTSEHAL

SEQ ID NO: 20422 - protein, 274 aa, Escherichia coli O157:H7 str. EC4206; identical to SEQ ID NO: 5731

SEQ ID NO: 20423 - protein, 252 aa, Escherichia coli O157:H7 str. EC4206; identical to SEQ ID NO: 11406

SEQ ID NO: 20424 - protein, 860 aa, Escherichia coli O157:H7 str. EC4206; identical to SEQ ID NO: 11720

SEQ ID NO: 20425 - protein, 614 aa, Escherichia coli O157:H7 str. EC4206; identical to SEQ ID NO: 5715

SEQ ID NO: 20426 - protein, 89 aa, Escherichia coli O157:H7 str. EC4206; identical to SEQ ID NO: 6233

SEQ ID NO: 20427 - protein, 567 aa, Escherichia coli O157:H7 str. EC4206; identical to SEQ ID NO: 11409

SEQ ID NO: 20428 - protein, 446 aa, Escherichia coli O157:H7 str. EC4206; identical to SEQ ID NO: 5714

SEQ ID NO: 20429 - protein, 696 aa, Escherichia coli O157:H7 str. EC4206; identical to SEQ ID NO: 6320

SEQ ID NO: 20430 - protein, 237 aa, Escherichia coli O157:H7 str. EC4206; identical to SEQ ID NO: 5713

SEQ ID NO: 20431 - protein, 478 aa, Escherichia coli O157:H7 str. EC4206; identical to SEQ ID NO: 5712

SEQ ID NO: 20432 - protein, 517 aa, Escherichia coli O157:H7 str. EC4206; identical to SEQ ID NO: 6817

SEQ ID NO: 20433 - protein, 191 aa, Escherichia coli O157:H7 str. EC4206; identical to SEQ ID NO: 5748

SEQ ID NO: 20434 - protein, 232 aa, Escherichia coli O157:H7 str. EC4206; identical to SEQ ID NO: 5747

SEQ ID NO: 20435 - protein, 660 aa, Escherichia coli O157:H7 str. EC4206; identical to SEQ ID NO: 11731

SEQ ID NO: 20436 - protein, 729 aa, Escherichia coli O157:H7 str. EC4206; identical to SEQ ID NO: 5745

SEQ ID NO: 20437 - protein, 213 aa, Escherichia coli O157:H7 str. EC4206; identical to SEQ ID NO: 5744

SEQ ID NO: 20438 - protein, 229 aa, Escherichia coli O157:H7 str. EC4206; identical to SEQ ID NO: 11418

SEQ ID NO: 20439 - protein, 230 aa, Escherichia coli O157:H7 str. EC4206; identical to SEQ ID NO: 5765

SEQ ID NO: 20440 - protein, 869 aa, Escherichia coli O157:H7 str. EC4206; identical to SEQ ID NO: 5763

SEQ ID NO: 20441 - protein, 746 aa, Escherichia coli O157:H7 str. EC4206; identical to SEQ ID NO: 5761

SEQ ID NO: 20442 - protein, 89 aa, Escherichia coli O157:H7 str. EC4206; identical to SEQ ID NO: 6053

SEQ ID NO: 20443 - protein, 359 aa, Escherichia coli O157:H7 str. EC4206; identical to SEQ ID NO: 11410

SEQ ID NO: 20444 - protein, 193 aa, Escherichia coli O157:H7 str. EC4206; identical to SEQ ID NO: 5760

SEQ ID NO: 20445 - protein, 713 aa, Escherichia coli O157:H7 str. EC4206; identical to SEQ ID NO: 11726

SEQ ID NO: 20446 - protein, 203 aa, Escherichia coli O157:H7 str. EC4206; identical to SEQ ID NO: 6347

SEQ ID NO: 20447 - protein, 368 aa, Escherichia coli O157:H7 str. EC4206; identical to SEQ ID NO: 11425

SEQ ID NO: 20448 - protein, 241 aa, Escherichia coli O157:H7 str. EC4206; identical to SEQ ID NO: 5709

SEQ ID NO: 20449 - protein, 863 aa, Escherichia coli O157:H7 str. EC4206; identical to SEQ ID NO: 11427

SEQ ID NO: 20450 - protein, 243 aa, Escherichia coli O157:H7 str. EC4206; identical to SEQ ID NO: 11367

SEQ ID NO: 20451 - protein, 430 aa, Escherichia coli O157:H7 str. EC4206; identical to SEQ ID NO: 5758

SEQ ID NO: 20452 - protein, 207 aa, Escherichia coli O157:H7 str. EC4206; identical to SEQ ID NO: 5743

SEQ ID NO: 20453 - protein, 715 aa, Escherichia coli O157:H7 str. EC4206; identical to SEQ ID NO: 11710

SEQ ID NO: 20454 - protein, 122 aa, Escherichia coli O157:H7 str. EC4206; identical to SEQ ID NO: 5737

SEQ ID NO: 20455 - protein, 111 aa, Escherichia coli O157:H7 str. EC4206; identical to SEQ ID NO: 5738

SEQ ID NO: 20456 - protein, 859 aa, Escherichia coli O157:H7 str. EC4206; identical to SEQ ID NO: 19736

SEQ ID NO: 20457 - protein, 539 aa, Escherichia coli O157:H7 str. EC4206; identical to SEQ ID NO: 6525

SEQ ID NO: 20458 - protein, 700 aa, Escherichia coli O157:H7 str. EC4206; identical to SEQ ID NO: 5740

SEQ ID NO: 20459 - protein, 366 aa, Escherichia coli O157:H7 str. EC4206; identical to SEQ ID NO: 11362

SEQ ID NO: 20460 - protein, 871 aa, Escherichia coli O157:H7 str. EC4206; identical to SEQ ID NO: 11363

SEQ ID NO: 20461 - protein, 236 aa, Escherichia coli O157:H7 str. EC4206; identical to SEQ ID NO: 11364

SEQ ID NO: 20462 - protein, 655 aa, Escherichia coli O157:H7 str. EC4206; identical to SEQ ID NO: 11466

SEQ ID NO: 20463 - protein, 998 aa, Escherichia coli O157:H7 str. EC4206; identical to SEQ ID NO: 5657

SEQ ID NO: 20464 - protein, 412 aa, Escherichia coli O157:H7 str. EC4401; identical to SEQ ID NO: 5719

SEQ ID NO: 20465 - protein, 660 aa, Escherichia coli O157:H7 str. EC4401; identical to SEQ ID NO: 11731

SEQ ID NO: 20466 - protein, 229 aa, Escherichia coli O157:H7 str. EC4401; identical to SEQ ID NO: 11418

SEQ ID NO: 20467 - protein, 512 aa, Escherichia coli O157:H7 str. EC4401; identical to SEQ ID NO: 5948

SEQ ID NO: 20468 - protein, 567 aa, Escherichia coli O157:H7 str. EC4401; identical to SEQ ID NO: 11409

SEQ ID NO: 20469 - protein, 359 aa, Escherichia coli O157:H7 str. EC4401; identical to SEQ ID NO: 11410

SEQ ID NO: 20470 - protein, 713 aa, Escherichia coli O157:H7 str. EC4401; identical to SEQ ID NO: 11726

SEQ ID NO: 20471 - protein, 231 aa, Escherichia coli O157:H7 str. EC4401; identical to SEQ ID NO: 5724

SEQ ID NO: 20472 - protein, 863 aa, Escherichia coli O157:H7 str. EC4401; identical to SEQ ID NO: 19681

SEQ ID NO: 20473 - protein, 678 aa, Escherichia coli O157:H7 str. EC4401; identical to SEQ ID NO: 5722

SEQ ID NO: 20474 - protein, 696 aa, Escherichia coli O157:H7 str. EC4401; identical to SEQ ID NO: 6320

SEQ ID NO: 20475 - protein, 517 aa, Escherichia coli O157:H7 str. EC4401; identical to SEQ ID NO: 6817

SEQ ID NO: 20476 - protein, 229 aa, Escherichia coli O157:H7 str. EC4401; identical to SEQ ID NO: 11455

SEQ ID NO: 20477 - protein, 233 aa, Escherichia coli O157:H7 str. EC4401; identical to SEQ ID NO: 11381

SEQ ID NO: 20478 - protein, 230 aa, Escherichia coli O157:H7 str. EC4401; identical to SEQ ID NO: 5765

SEQ ID NO: 20479 - protein, 869 aa, Escherichia coli O157:H7 str. EC4401; identical to SEQ ID NO: 5763

SEQ ID NO: 20480 - protein, 746 aa, Escherichia coli O157:H7 str. EC4401; identical to SEQ ID NO: 5761

SEQ ID NO: 20481 - protein, 368 aa, Escherichia coli O157:H7 str. EC4401; identical to SEQ ID NO: 11425

SEQ ID NO: 20482 - protein, 241 aa, Escherichia coli O157:H7 str. EC4401; identical to SEQ ID NO: 5709

SEQ ID NO: 20483 - protein, 863 aa, Escherichia coli O157:H7 str. EC4401; identical to SEQ ID NO: 11427

SEQ ID NO: 20484 - protein, 828 aa, Escherichia coli O157:H7 str. EC4401; identical to SEQ ID NO: 5735

SEQ ID NO: 20485 - protein, 162 aa, Escherichia coli O157:H7 str. EC4401; identical to SEQ ID NO: 5734

SEQ ID NO: 20486 - protein, 365 aa, Escherichia coli O157:H7 str. EC4401
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGREALRQNGDGVGGSITYDYEGFGIGAAVSSSKRTDDQNSPLYIGNGDRAETYTGGLKYDANNIYLAAQYTQTYNATRVGSLGWANKAQNFEAVAQYSSTSSASVLAYLQSKGKPGCHHGRNYDDEDILKYVDVGATYYFNKNMSTYVDYKINLLDDNQFTRDAGINTDNIVALGLVYQF

SEQ ID NO: 20487 - protein, 200 aa, Escherichia coli O157:H7 str. EC4401; identical to SEQ ID NO: 5733

SEQ ID NO: 20488 - protein, 274 aa, Escherichia coli O157:H7 str. EC4401; identical to SEQ ID NO: 5731

SEQ ID NO: 20489 - protein, 252 aa, Escherichia coli O157:H7 str. EC4401; identical to SEQ ID NO: 11406

SEQ ID NO: 20490 - protein, 860 aa, Escherichia coli O157:H7 str. EC4401; identical to SEQ ID NO: 11720

SEQ ID NO: 20491 - protein, 89 aa, Escherichia coli O157:H7 str. EC4401
MKKMFMAVLFALVSVNAMAADCAKGKIEFSKYNENDTFTVKVDGKEYWTSRWNLQPLLQSAQLTGMTVTIKSSTCESGSGFAEVQFNND

SEQ ID NO: 20492 - protein, 446 aa, Escherichia coli O157:H7 str. EC4401; identical to SEQ ID NO: 5714

SEQ ID NO: 20493 - protein, 237 aa, Escherichia coli O157:H7 str. EC4401; identical to SEQ ID NO: 5713

SEQ ID NO: 20494 - protein, 478 aa, Escherichia coli O157:H7 str. EC4401; identical to SEQ ID NO: 5712

SEQ ID NO: 20495 - protein, 208 aa, Escherichia coli O157:H7 str. EC4401; identical to SEQ ID NO: 5717

SEQ ID NO: 20496 - protein, 614 aa, Escherichia coli O157:H7 str. EC4401
MIKKASLLTACSVTAFSSWAQDTSPDTLVVTANRFEQPRSTVLAPTTVVTRQDIDRWQSTSVNDVLRRLPGVDITQNGGSGQLSSIFIRGTNASHVLVLIDGVRLNLAGGSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGSPLVDTRKLYSQSWDAGLRYNGELIKSQLITSYSHSKDYNYDPHYGRYDSSATLDEMKQYTVQWANNIIIGHGNVGAGVDWQKQSTAPGTAYVKDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 20497 - protein, 241 aa, Escherichia coli O157:H7 str. EC4401; identical to SEQ ID NO: 11431

SEQ ID NO: 20498 - protein, 747 aa, Escherichia coli O157:H7 str. EC4401; identical to SEQ ID NO: 5775

SEQ ID NO: 20499 - protein, 266 aa, Escherichia coli O157:H7 str. EC4401; identical to SEQ ID NO: 5771

SEQ ID NO: 20500 - protein, 161 aa, Escherichia coli O157:H7 str. EC4401; identical to SEQ ID NO: 5769

SEQ ID NO: 20501 - protein, 539 aa, Escherichia coli O157:H7 str. EC4401; identical to SEQ ID NO: 6525

SEQ ID NO: 20502 - protein, 700 aa, Escherichia coli O157:H7 str. EC4401; identical to SEQ ID NO: 5740

SEQ ID NO: 20503 - protein, 366 aa, Escherichia coli O157:H7 str. EC4401; identical to SEQ ID NO: 11362

SEQ ID NO: 20504 - protein, 871 aa, Escherichia coli O157:H7 str. EC4401; identical to SEQ ID NO: 11363

SEQ ID NO: 20505 - protein, 236 aa, Escherichia coli O157:H7 str. EC4401; identical to SEQ ID NO: 11364

SEQ ID NO: 20506 - protein, 826 aa, Escherichia coli O157:H7 str. EC4401; identical to SEQ ID NO: 11397

SEQ ID NO: 20507 - protein, 240 aa, Escherichia coli O157:H7 str. EC4401; identical to SEQ ID NO: 19813

SEQ ID NO: 20508 - protein, 203 aa, Escherichia coli O157:H7 str. EC4401; identical to SEQ ID NO: 6347

SEQ ID NO: 20509 - protein, 331 aa, Escherichia coli O157:H7 str. EC4401; identical to SEQ ID NO: 6551

SEQ ID NO: 20510 - protein, 760 aa, Escherichia coli O157:H7 str. EC4401; identical to SEQ ID NO: 5756

SEQ ID NO: 20511 - protein, 227 aa, Escherichia coli O157:H7 str. EC4401; identical to SEQ ID NO: 11429

SEQ ID NO: 20512 - protein, 203 aa, Escherichia coli O157:H7 str. EC4401; identical to SEQ ID NO: 6414

SEQ ID NO: 20513 - protein, 362 aa, Escherichia coli O157:H7 str. EC4401; identical to SEQ ID NO: 5754

SEQ ID NO: 20514 - protein, 224 aa, Escherichia coli O157:H7 str. EC4401; identical to SEQ ID NO: 11374

SEQ ID NO: 20515 - protein, 242 aa, Escherichia coli O157:H7 str. EC4401
MTFVKGFPLILCASMCSHGAVQPDRTRIIFNSKDKATSLRVENRSDKLPYLAYSWIENEKGEKSDEFLVALPPIQRLEPKATSQVRIMKQAATAKLPTDRESLFYYNLREIPPVPEGSEGHAILQVAVQSRIKLFWRPAALRKKMGDHVEQQLQVSQQNNQLTLKTPTGYYLTIAYLGRDEKGVLPGFKSTMVAPFSSVTTSTGSYSGKQFYLGYMDDYGALRMNTLSCQRQCRLQPVENKK

SEQ ID NO: 20516 - protein, 351 aa, Escherichia coli O157:H7 str. EC4401; identical to SEQ ID NO: 5767

SEQ ID NO: 20517 - protein, 998 aa, Escherichia coli O157:H7 str. EC4401; identical to SEQ ID NO: 5657

SEQ ID NO: 20518 - protein, 650 aa, Escherichia coli O157:H7 str. EC4401; identical to SEQ ID NO: 11539

SEQ ID NO: 20519 - protein, 111 aa, Escherichia coli O157:H7 str. EC4401; identical to SEQ ID NO: 5738

SEQ ID NO: 20520 - protein, 627 aa, Escherichia coli O157:H7 str. EC4401; identical to SEQ ID NO: 11401

SEQ ID NO: 20521 - protein, 518 aa, Escherichia coli O157:H7 str. EC4401; identical to SEQ ID NO: 11400

SEQ ID NO: 20522 - protein, 729 aa, Escherichia coli O157:H7 str. EC4401; identical to SEQ ID NO: 5745

SEQ ID NO: 20523 - protein, 213 aa, Escherichia coli O157:H7 str. EC4401; identical to SEQ ID NO: 5744

SEQ ID NO: 20524 - protein, 859 aa, Escherichia coli O157:H7 str. EC4401; identical to SEQ ID NO: 19736

SEQ ID NO: 20525 - protein, 193 aa, Escherichia coli O157:H7 str. EC4401; identical to SEQ ID NO: 5760

SEQ ID NO: 20526 - protein, 715 aa, Escherichia coli O157:H7 str. EC4401; identical to SEQ ID NO: 11710

SEQ ID NO: 20527 - protein, 122 aa, Escherichia coli O157:H7 str. EC4401; identical to SEQ ID NO: 5737

SEQ ID NO: 20528 - protein, 232 aa, Escherichia coli O157:H7 str. EC4401; identical to SEQ ID NO: 5747

SEQ ID NO: 20529 - protein, 191 aa, Escherichia coli O157:H7 str. EC4401; identical to SEQ ID NO: 5748

SEQ ID NO: 20530 - protein, 89 aa, Escherichia coli O157:H7 str. EC4401; identical to SEQ ID NO: 6053

SEQ ID NO: 20531 - protein, 412 aa, Escherichia coli O157:H7 str. EC4486; identical to SEQ ID NO: 5719

SEQ ID NO: 20532 - protein, 660 aa, Escherichia coli O157:H7 str. EC4486; identical to SEQ ID NO: 11731

SEQ ID NO: 20533 - protein, 229 aa, Escherichia coli O157:H7 str. EC4486; identical to SEQ ID NO: 11418

SEQ ID NO: 20534 - protein, 512 aa, Escherichia coli O157:H7 str. EC4486; identical to SEQ ID NO: 5948

SEQ ID NO: 20535 - protein, 446 aa, Escherichia coli O157:H7 str. EC4486; identical to SEQ ID NO: 5714

SEQ ID NO: 20536 - protein, 237 aa, Escherichia coli O157:H7 str. EC4486; identical to SEQ ID NO: 5713

SEQ ID NO: 20537 - protein, 478 aa, Escherichia coli O157:H7 str. EC4486; identical to SEQ ID NO: 5712

SEQ ID NO: 20538 - protein, 368 aa, Escherichia coli O157:H7 str. EC4486; identical to SEQ ID NO: 11425

SEQ ID NO: 20539 - protein, 241 aa, Escherichia coli O157:H7 str. EC4486; identical to SEQ ID NO: 5709

SEQ ID NO: 20540 - protein, 863 aa, Escherichia coli O157:H7 str. EC4486; identical to SEQ ID NO: 11427

SEQ ID NO: 20541 - protein, 227 aa, Escherichia coli O157:H7 str. EC4486; identical to SEQ ID NO: 11429

SEQ ID NO: 20542 - protein, 784 aa, Escherichia coli O157:H7 str. EC4486; identical to SEQ ID NO: 5705

SEQ ID NO: 20543 - protein, 567 aa, Escherichia coli O157:H7 str. EC4486; identical to SEQ ID NO: 11409

SEQ ID NO: 20544 - protein, 359 aa, Escherichia coli O157:H7 str. EC4486; identical to SEQ ID NO: 11410

SEQ ID NO: 20545 - protein, 713 aa, Escherichia coli O157:H7 str. EC4486; identical to SEQ ID NO: 11726

SEQ ID NO: 20546 - protein, 193 aa, Escherichia coli O157:H7 str. EC4486; identical to SEQ ID NO: 5760

SEQ ID NO: 20547 - protein, 243 aa, Escherichia coli O157:H7 str. EC4486; identical to SEQ ID NO: 11367

SEQ ID NO: 20548 - protein, 816 aa, Escherichia coli O157:H7 str. EC4486; identical to SEQ ID NO: 11682

SEQ ID NO: 20549 - protein, 430 aa, Escherichia coli O157:H7 str. EC4486; identical to SEQ ID NO: 5758

SEQ ID NO: 20550 - protein, 331 aa, Escherichia coli O157:H7 str. EC4486; identical to SEQ ID NO: 6551

SEQ ID NO: 20551 - protein, 760 aa, Escherichia coli O157:H7 str. EC4486; identical to SEQ ID NO: 5756

SEQ ID NO: 20552 - protein, 229 aa, Escherichia coli O157:H7 str. EC4486; identical to SEQ ID NO: 11455

SEQ ID NO: 20553 - protein, 233 aa, Escherichia coli O157:H7 str. EC4486; identical to SEQ ID NO: 11381

SEQ ID NO: 20554 - protein, 696 aa, Escherichia coli O157:H7 str. EC4486; identical to SEQ ID NO: 6320

SEQ ID NO: 20555 - protein, 517 aa, Escherichia coli O157:H7 str. EC4486; identical to SEQ ID NO: 6817

SEQ ID NO: 20556 - protein, 191 aa, Escherichia coli O157:H7 str. EC4486; identical to SEQ ID NO: 5748

SEQ ID NO: 20557 - protein, 232 aa, Escherichia coli O157:H7 str. EC4486; identical to SEQ ID NO: 5747

SEQ ID NO: 20558 - protein, 659 aa, Escherichia coli O157:H7 str. EC4486; identical to SEQ ID NO: 5736

SEQ ID NO: 20559 - protein, 828 aa, Escherichia coli O157:H7 str. EC4486; identical to SEQ ID NO: 5735

SEQ ID NO: 20560 - protein, 162 aa, Escherichia coli O157:H7 str. EC4486; identical to SEQ ID NO: 5734

SEQ ID NO: 20561 - protein, 367 aa, Escherichia coli O157:H7 str. EC4486; identical to SEQ ID NO: 5700

SEQ ID NO: 20562 - protein, 200 aa, Escherichia coli O157:H7 str. EC4486; identical to SEQ ID NO: 5733

SEQ ID NO: 20563 - protein, 274 aa, Escherichia coli O157:H7 str. EC4486; identical to SEQ ID NO: 5731

SEQ ID NO: 20564 - protein, 252 aa, Escherichia coli O157:H7 str. EC4486; identical to SEQ ID NO: 11406

SEQ ID NO: 20565 - protein, 879 aa, Escherichia coli O157:H7 str. EC4486; identical to SEQ ID NO: 19287

SEQ ID NO: 20566 - protein, 89 aa, Escherichia coli O157:H7 str. EC4486; identical to SEQ ID NO: 6233

SEQ ID NO: 20567 - protein, 208 aa, Escherichia coli O157:H7 str. EC4486; identical to SEQ ID NO: 5717

SEQ ID NO: 20568 - protein, 614 aa, Escherichia coli O157:H7 str. EC4486; identical to SEQ ID NO: 20496

SEQ ID NO: 20569 - protein, 230 aa, Escherichia coli O157:H7 str. EC4486; identical to SEQ ID NO: 5765

SEQ ID NO: 20570 - protein, 869 aa, Escherichia coli O157:H7 str. EC4486; identical to SEQ ID NO: 5763

SEQ ID NO: 20571 - protein, 518 aa, Escherichia coli O157:H7 str. EC4486; identical to SEQ ID NO: 11400

SEQ ID NO: 20572 - protein, 236 aa, Escherichia coli O157:H7 str. EC4486; identical to SEQ ID NO: 11364

SEQ ID NO: 20573 - protein, 871 aa, Escherichia coli O157:H7 str. EC4486; identical to SEQ ID NO: 11363

SEQ ID NO: 20574 - protein, 366 aa, Escherichia coli O157:H7 str. EC4486; identical to SEQ ID NO: 11362

SEQ ID NO: 20575 - protein, 700 aa, Escherichia coli O157:H7 str. EC4486; identical to SEQ ID NO: 5740

SEQ ID NO: 20576 - protein, 650 aa, Escherichia coli O157:H7 str. EC4486; identical to SEQ ID NO: 11539

SEQ ID NO: 20577 - protein, 998 aa, Escherichia coli O157:H7 str. EC4486; identical to SEQ ID NO: 5657

SEQ ID NO: 20578 - protein, 231 aa, Escherichia coli O157:H7 str. EC4486; identical to SEQ ID NO: 5724

SEQ ID NO: 20579 - protein, 863 aa, Escherichia coli O157:H7 str. EC4486; identical to SEQ ID NO: 19681

SEQ ID NO: 20580 - protein, 678 aa, Escherichia coli O157:H7 str. EC4486; identical to SEQ ID NO: 5722

SEQ ID NO: 20581 - protein, 203 aa, Escherichia coli O157:H7 str. EC4486; identical to SEQ ID NO: 6414

SEQ ID NO: 20582 - protein, 362 aa, Escherichia coli O157:H7 str. EC4486; identical to SEQ ID NO: 5754

SEQ ID NO: 20583 - protein, 224 aa, Escherichia coli O157:H7 str. EC4486; identical to SEQ ID NO: 11374

SEQ ID NO: 20584 - protein, 351 aa, Escherichia coli O157:H7 str. EC4486; identical to SEQ ID NO: 5767

SEQ ID NO: 20585 - protein, 826 aa, Escherichia coli O157:H7 str. EC4486; identical to SEQ ID NO: 11397

SEQ ID NO: 20586 - protein, 240 aa, Escherichia coli O157:H7 str. EC4486; identical to SEQ ID NO: 19813

SEQ ID NO: 20587 - protein, 746 aa, Escherichia coli O157:H7 str. EC4486; identical to SEQ ID NO: 5761

SEQ ID NO: 20588 - protein, 715 aa, Escherichia coli O157:H7 str. EC4486; identical to SEQ ID NO: 11710

SEQ ID NO: 20589 - protein, 266 aa, Escherichia coli O157:H7 str. EC4486; identical to SEQ ID NO: 5771

SEQ ID NO: 20590 - protein, 747 aa, Escherichia coli O157:H7 str. EC4486; identical to SEQ ID NO: 5775

SEQ ID NO: 20591 - protein, 241 aa, Escherichia coli O157:H7 str. EC4486; identical to SEQ ID NO: 11431

SEQ ID NO: 20592 - protein, 122 aa, Escherichia coli O157:H7 str. EC4486; identical to SEQ ID NO: 5737

SEQ ID NO: 20593 - protein, 203 aa, Escherichia coli O157:H7 str. EC4486; identical to SEQ ID NO: 6347

SEQ ID NO: 20594 - protein, 207 aa, Escherichia coli O157:H7 str. EC4486; identical to SEQ ID NO: 5743

SEQ ID NO: 20595 - protein, 729 aa, Escherichia coli O157:H7 str. EC4486; identical to SEQ ID NO: 5745

SEQ ID NO: 20596 - protein, 213 aa, Escherichia coli O157:H7 str. EC4486; identical to SEQ ID NO: 5744

SEQ ID NO: 20597 - protein, 89 aa, Escherichia coli O157:H7 str. EC4486; identical to SEQ ID NO: 6053

SEQ ID NO: 20598 - protein, 111 aa, Escherichia coli O157:H7 str. EC4486; identical to SEQ ID NO: 5738

SEQ ID NO: 20599 - protein, 412 aa, Escherichia coli O157:H7 str. EC4501; identical to SEQ ID NO: 5719

SEQ ID NO: 20600 - protein, 660 aa, Escherichia coli O157:H7 str. EC4501
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVGASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIDHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 20601 - protein, 229 aa, Escherichia coli O157:H7 str. EC4501; identical to SEQ ID NO: 11418

SEQ ID NO: 20602 - protein, 512 aa, Escherichia coli O157:H7 str. EC4501; identical to SEQ ID NO: 5948

SEQ ID NO: 20603 - protein, 567 aa, Escherichia coli O157:H7 str. EC4501; identical to SEQ ID NO: 11409

SEQ ID NO: 20604 - protein, 359 aa, Escherichia coli O157:H7 str. EC4501; identical to SEQ ID NO: 11410

SEQ ID NO: 20605 - protein, 713 aa, Escherichia coli O157:H7 str. EC4501; identical to SEQ ID NO: 11411

SEQ ID NO: 20606 - protein, 746 aa, Escherichia coli O157:H7 str. EC4501; identical to SEQ ID NO: 5761

SEQ ID NO: 20607 - protein, 869 aa, Escherichia coli O157:H7 str. EC4501; identical to SEQ ID NO: 5763

SEQ ID NO: 20608 - protein, 230 aa, Escherichia coli O157:H7 str. EC4501; identical to SEQ ID NO: 5765

SEQ ID NO: 20609 - protein, 368 aa, Escherichia coli O157:H7 str. EC4501; identical to SEQ ID NO: 11425

SEQ ID NO: 20610 - protein, 241 aa, Escherichia coli O157:H7 str. EC4501; identical to SEQ ID NO: 5709

SEQ ID NO: 20611 - protein, 863 aa, Escherichia coli O157:H7 str. EC4501; identical to SEQ ID NO: 11427

SEQ ID NO: 20612 - protein, 517 aa, Escherichia coli O157:H7 str. EC4501; identical to SEQ ID NO: 6817

SEQ ID NO: 20613 - protein, 696 aa, Escherichia coli O157:H7 str. EC4501; identical to SEQ ID NO: 6320

SEQ ID NO: 20614 - protein, 233 aa, Escherichia coli O157:H7 str. EC4501; identical to SEQ ID NO: 11381

SEQ ID NO: 20615 - protein, 840 aa, Escherichia coli O157:H7 str. EC4501; identical to SEQ ID NO: 11380

SEQ ID NO: 20616 - protein, 229 aa, Escherichia coli O157:H7 str. EC4501; identical to SEQ ID NO: 11455

SEQ ID NO: 20617 - protein, 446 aa, Escherichia coli O157:H7 str. EC4501; identical to SEQ ID NO: 5714

SEQ ID NO: 20618 - protein, 237 aa, Escherichia coli O157:H7 str. EC4501; identical to SEQ ID NO: 5713

SEQ ID NO: 20619 - protein, 478 aa, Escherichia coli O157:H7 str. EC4501; identical to SEQ ID NO: 5711

SEQ ID NO: 20620 - protein, 518 aa, Escherichia coli O157:H7 str. EC4501; identical to SEQ ID NO: 11400

SEQ ID NO: 20621 - protein, 860 aa, Escherichia coli O157:H7 str. EC4501; identical to SEQ ID NO: 11407

SEQ ID NO: 20622 - protein, 252 aa, Escherichia coli O157:H7 str. EC4501; identical to SEQ ID NO: 11406

SEQ ID NO: 20623 - protein, 274 aa, Escherichia coli O157:H7 str. EC4501; identical to SEQ ID NO: 5731

SEQ ID NO: 20624 - protein, 200 aa, Escherichia coli O157:H7 str. EC4501; identical to SEQ ID NO: 5732

SEQ ID NO: 20625 - protein, 236 aa, Escherichia coli O157:H7 str. EC4501; identical to SEQ ID NO: 11364

SEQ ID NO: 20626 - protein, 871 aa, Escherichia coli O157:H7 str. EC4501; identical to SEQ ID NO: 11363

SEQ ID NO: 20627 - protein, 366 aa, Escherichia coli O157:H7 str. EC4501; identical to SEQ ID NO: 11362

SEQ ID NO: 20628 - protein, 700 aa, Escherichia coli O157:H7 str. EC4501; identical to SEQ ID NO: 5740

SEQ ID NO: 20629 - protein, 614 aa, Escherichia coli O157:H7 str. EC4501; identical to SEQ ID NO: 5715

SEQ ID NO: 20630 - protein, 826 aa, Escherichia coli O157:H7 str. EC4501; identical to SEQ ID NO: 11397

SEQ ID NO: 20631 - protein, 224 aa, Escherichia coli O157:H7 str. EC4501; identical to SEQ ID NO: 11398

SEQ ID NO: 20632 - protein, 231 aa, Escherichia coli O157:H7 str. EC4501; identical to SEQ ID NO: 5724

SEQ ID NO: 20633 - protein, 863 aa, Escherichia coli O157:H7 str. EC4501; identical to SEQ ID NO: 19681

SEQ ID NO: 20634 - protein, 678 aa, Escherichia coli O157:H7 str. EC4501; identical to SEQ ID NO: 5722

SEQ ID NO: 20635 - protein, 122 aa, Escherichia coli O157:H7 str. EC4501; identical to SEQ ID NO: 5737

SEQ ID NO: 20636 - protein, 816 aa, Escherichia coli O157:H7 str. EC4501; identical to SEQ ID NO: 11428

SEQ ID NO: 20637 - protein, 227 aa, Escherichia coli O157:H7 str. EC4501; identical to SEQ ID NO: 11429

SEQ ID NO: 20638 - protein, 224 aa, Escherichia coli O157:H7 str. EC4501; identical to SEQ ID NO: 11374

SEQ ID NO: 20639 - protein, 362 aa, Escherichia coli O157:H7 str. EC4501; identical to SEQ ID NO: 5754

SEQ ID NO: 20640 - protein, 203 aa, Escherichia coli O157:H7 str. EC4501; identical to SEQ ID NO: 6414

SEQ ID NO: 20641 - protein, 998 aa, Escherichia coli O157:H7 str. EC4501; identical to SEQ ID NO: 6058

SEQ ID NO: 20642 - protein, 650 aa, Escherichia coli O157:H7 str. EC4501; identical to SEQ ID NO: 11539

SEQ ID NO: 20643 - protein, 539 aa, Escherichia coli O157:H7 str. EC4501; identical to SEQ ID NO: 6525

SEQ ID NO: 20644 - protein, 351 aa, Escherichia coli O157:H7 str. EC4501; identical to SEQ ID NO: 5767

SEQ ID NO: 20645 - protein, 132 aa, Escherichia coli O157:H7 str. EC4501
MKKQIEGMTMKKVLALVVAAAMGLSSAAFAAETATTPAPTATTTKAAPAKTTHHKKQHKAAPAQKAQAAKKHHKNTKAEQKAPEQKAQAAKKHHKNTKAEQKAPEQKAQAAKKHAKKHSHQQPAKPAAQPAA

SEQ ID NO: 20646 - protein, 659 aa, Escherichia coli O157:H7 str. EC4501
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNSGAAWQVTKDVKLRAGVLNLGDKDLSRDDYSYNEDGRRYFMAVDYRF

SEQ ID NO: 20647 - protein, 243 aa, Escherichia coli O157:H7 str. EC4501; identical to SEQ ID NO: 11367

SEQ ID NO: 20648 - protein, 715 aa, Escherichia coli O157:H7 str. EC4501; identical to SEQ ID NO: 11710

SEQ ID NO: 20649 - protein, 89 aa, Escherichia coli O157:H7 str. EC4501; identical to SEQ ID NO: 6232

SEQ ID NO: 20650 - protein, 760 aa, Escherichia coli O157:H7 str. EC4501; identical to SEQ ID NO: 5756

SEQ ID NO: 20651 - protein, 331 aa, Escherichia coli O157:H7 str. EC4501; identical to SEQ ID NO: 6551

SEQ ID NO: 20652 - protein, 266 aa, Escherichia coli O157:H7 str. EC4501; identical to SEQ ID NO: 5771

SEQ ID NO: 20653 - protein, 747 aa, Escherichia coli O157:H7 str. EC4501; identical to SEQ ID NO: 5774

SEQ ID NO: 20654 - protein, 203 aa, Escherichia coli O157:H7 str. EC4501; identical to SEQ ID NO: 6347

SEQ ID NO: 20655 - protein, 656 aa, Escherichia coli O157:H7 str. EC4501; identical to SEQ ID NO: 11390

SEQ ID NO: 20656 - protein, 207 aa, Escherichia coli O157:H7 str. EC4501
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILCLPGDATDYKLDDQYRLSEITYSQNGKNWKVVYGGYDTKTQPAMPANMELTDGGQRIKLKMDNWIVK

SEQ ID NO: 20657 - protein, 191 aa, Escherichia coli O157:H7 str. EC4501; identical to SEQ ID NO: 5748

SEQ ID NO: 20658 - protein, 232 aa, Escherichia coli O157:H7 str. EC4501; identical to SEQ ID NO: 5747

SEQ ID NO: 20659 - protein, 193 aa, Escherichia coli O157:H7 str. EC4501; identical to SEQ ID NO: 5760

SEQ ID NO: 20660 - protein, 828 aa, Escherichia coli O157:H7 str. EC4501; identical to SEQ ID NO: 5735

SEQ ID NO: 20661 - protein, 162 aa, Escherichia coli O157:H7 str. EC4501; identical to SEQ ID NO: 5734

SEQ ID NO: 20662 - protein, 241 aa, Escherichia coli O157:H7 str. EC4501; identical to SEQ ID NO: 11431

SEQ ID NO: 20663 - protein, 213 aa, Escherichia coli O157:H7 str. EC4501; identical to SEQ ID NO: 5744

SEQ ID NO: 20664 - protein, 729 aa, Escherichia coli O157:H7 str. EC4501; identical to SEQ ID NO: 5745

SEQ ID NO: 20665 - protein, 89 aa, Escherichia coli O157:H7 str. EC4501; identical to SEQ ID NO: 6233

SEQ ID NO: 20666 - protein, 208 aa, Escherichia coli O157:H7 str. EC4501; identical to SEQ ID NO: 5717

SEQ ID NO: 20667 - protein, 87 aa, Escherichia coli O157:H7 str. EC4501
EDVYGGFIALASVNAMAADCAKGKIEFSKYNEDDTFTVKVDGKEYWTSRWNLQPLLQSAQLTGMTVTIKSSTCESGSGFAEVQFNND

SEQ ID NO: 20668 - protein, 412 aa, Escherichia coli O157:H7 str. EC508; identical to SEQ ID NO: 5719

SEQ ID NO: 20669 - protein, 660 aa, Escherichia coli O157:H7 str. EC508; identical to SEQ ID NO: 11731

SEQ ID NO: 20670 - protein, 229 aa, Escherichia coli O157:H7 str. EC508; identical to SEQ ID NO: 11418

SEQ ID NO: 20671 - protein, 231 aa, Escherichia coli O157:H7 str. EC508; identical to SEQ ID NO: 5724

SEQ ID NO: 20672 - protein, 863 aa, Escherichia coli O157:H7 str. EC508; identical to SEQ ID NO: 19681

SEQ ID NO: 20673 - protein, 678 aa, Escherichia coli O157:H7 str. EC508; identical to SEQ ID NO: 5722

SEQ ID NO: 20674 - protein, 359 aa, Escherichia coli O157:H7 str. EC508; identical to SEQ ID NO: 11410

SEQ ID NO: 20675 - protein, 689 aa, Escherichia coli O157:H7 str. EC508; identical to SEQ ID NO: 11798

SEQ ID NO: 20676 - protein, 368 aa, Escherichia coli O157:H7 str. EC508; identical to SEQ ID NO: 11425

SEQ ID NO: 20677 - protein, 241 aa, Escherichia coli O157:H7 str. EC508; identical to SEQ ID NO: 5709

SEQ ID NO: 20678 - protein, 878 aa, Escherichia coli O157:H7 str. EC508; identical to SEQ ID NO: 5707

SEQ ID NO: 20679 - protein, 816 aa, Escherichia coli O157:H7 str. EC508; identical to SEQ ID NO: 11428

SEQ ID NO: 20680 - protein, 227 aa, Escherichia coli O157:H7 str. EC508; identical to SEQ ID NO: 11429

SEQ ID NO: 20681 - protein, 230 aa, Escherichia coli O157:H7 str. EC508; identical to SEQ ID NO: 5765

SEQ ID NO: 20682 - protein, 869 aa, Escherichia coli O157:H7 str. EC508; identical to SEQ ID NO: 5763

SEQ ID NO: 20683 - protein, 746 aa, Escherichia coli O157:H7 str. EC508; identical to SEQ ID NO: 5761

SEQ ID NO: 20684 - protein, 478 aa, Escherichia coli O157:H7 str. EC508; identical to SEQ ID NO: 5711

SEQ ID NO: 20685 - protein, 237 aa, Escherichia coli O157:H7 str. EC508; identical to SEQ ID NO: 5713

SEQ ID NO: 20686 - protein, 446 aa, Escherichia coli O157:H7 str. EC508; identical to SEQ ID NO: 5714

SEQ ID NO: 20687 - protein, 200 aa, Escherichia coli O157:H7 str. EC508; identical to SEQ ID NO: 5732

SEQ ID NO: 20688 - protein, 274 aa, Escherichia coli O157:H7 str. EC508; identical to SEQ ID NO: 5731

SEQ ID NO: 20689 - protein, 252 aa, Escherichia coli O157:H7 str. EC508; identical to SEQ ID NO: 11406

SEQ ID NO: 20690 - protein, 860 aa, Escherichia coli O157:H7 str. EC508; identical to SEQ ID NO: 11720

SEQ ID NO: 20691 - protein, 89 aa, Escherichia coli O157:H7 str. EC508; identical to SEQ ID NO: 6233

SEQ ID NO: 20692 - protein, 512 aa, Escherichia coli O157:H7 str. EC508; identical to SEQ ID NO: 5948

SEQ ID NO: 20693 - protein, 518 aa, Escherichia coli O157:H7 str. EC508; identical to SEQ ID NO: 11400

SEQ ID NO: 20694 - protein, 224 aa, Escherichia coli O157:H7 str. EC508; identical to SEQ ID NO: 11398

SEQ ID NO: 20695 - protein, 826 aa, Escherichia coli O157:H7 str. EC508; identical to SEQ ID NO: 11397

SEQ ID NO: 20696 - protein, 696 aa, Escherichia coli O157:H7 str. EC508; identical to SEQ ID NO: 6320

SEQ ID NO: 20697 - protein, 229 aa, Escherichia coli O157:H7 str. EC508; identical to SEQ ID NO: 11455

SEQ ID NO: 20698 - protein, 840 aa, Escherichia coli O157:H7 str. EC508; identical to SEQ ID NO: 11380

SEQ ID NO: 20699 - protein, 233 aa, Escherichia coli O157:H7 str. EC508; identical to SEQ ID NO: 11381

SEQ ID NO: 20700 - protein, 236 aa, Escherichia coli O157:H7 str. EC508; identical to SEQ ID NO: 11364

SEQ ID NO: 20701 - protein, 883 aa, Escherichia coli O157:H7 str. EC508; identical to SEQ ID NO: 5702

SEQ ID NO: 20702 - protein, 366 aa, Escherichia coli O157:H7 str. EC508; identical to SEQ ID NO: 11362

SEQ ID NO: 20703 - protein, 700 aa, Escherichia coli O157:H7 str. EC508; identical to SEQ ID NO: 5740

SEQ ID NO: 20704 - protein, 614 aa, Escherichia coli O157:H7 str. EC508; identical to SEQ ID NO: 5715

SEQ ID NO: 20705 - protein, 539 aa, Escherichia coli O157:H7 str. EC508; identical to SEQ ID NO: 6525

SEQ ID NO: 20706 - protein, 760 aa, Escherichia coli O157:H7 str. EC508; identical to SEQ ID NO: 5756

SEQ ID NO: 20707 - protein, 331 aa, Escherichia coli O157:H7 str. EC508; identical to SEQ ID NO: 6551

SEQ ID NO: 20708 - protein, 567 aa, Escherichia coli O157:H7 str. EC508; identical to SEQ ID NO: 11409

SEQ ID NO: 20709 - protein, 351 aa, Escherichia coli O157:H7 str. EC508; identical to SEQ ID NO: 5767

SEQ ID NO: 20710 - protein, 111 aa, Escherichia coli O157:H7 str. EC508; identical to SEQ ID NO: 5738

SEQ ID NO: 20711 - protein, 627 aa, Escherichia coli O157:H7 str. EC508; identical to SEQ ID NO: 11401

SEQ ID NO: 20712 - protein, 816 aa, Escherichia coli O157:H7 str. EC508; identical to SEQ ID NO: 11682

SEQ ID NO: 20713 - protein, 243 aa, Escherichia coli O157:H7 str. EC508; identical to SEQ ID NO: 11367

SEQ ID NO: 20714 - protein, 203 aa, Escherichia coli O157:H7 str. EC508
MKKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQKNGAVDAAKFTFTPPQGVTVDDQRK

SEQ ID NO: 20715 - protein, 241 aa, Escherichia coli O157:H7 str. EC508; identical to SEQ ID NO: 11431

SEQ ID NO: 20716 - protein, 715 aa, Escherichia coli O157:H7 str. EC508; identical to SEQ ID NO: 11710

SEQ ID NO: 20717 - protein, 517 aa, Escherichia coli O157:H7 str. EC508; identical to SEQ ID NO: 6817

SEQ ID NO: 20718 - protein, 191 aa, Escherichia coli O157:H7 str. EC508; identical to SEQ ID NO: 5748

SEQ ID NO: 20719 - protein, 232 aa, Escherichia coli O157:H7 str. EC508; identical to SEQ ID NO: 5747

SEQ ID NO: 20720 - protein, 203 aa, Escherichia coli O157:H7 str. EC508; identical to SEQ ID NO: 6347

SEQ ID NO: 20721 - protein, 656 aa, Escherichia coli O157:H7 str. EC508; identical to SEQ ID NO: 11390

SEQ ID NO: 20722 - protein, 747 aa, Escherichia coli O157:H7 str. EC508; identical to SEQ ID NO: 5775

SEQ ID NO: 20723 - protein, 266 aa, Escherichia coli O157:H7 str. EC508; identical to SEQ ID NO: 5771

SEQ ID NO: 20724 - protein, 122 aa, Escherichia coli O157:H7 str. EC508; identical to SEQ ID NO: 5737

SEQ ID NO: 20725 - protein, 828 aa, Escherichia coli O157:H7 str. EC508; identical to SEQ ID NO: 5735

SEQ ID NO: 20726 - protein, 162 aa, Escherichia coli O157:H7 str. EC508; identical to SEQ ID NO: 5734

SEQ ID NO: 20727 - protein, 193 aa, Escherichia coli O157:H7 str. EC508; identical to SEQ ID NO: 5760

SEQ ID NO: 20728 - protein, 213 aa, Escherichia coli O157:H7 str. EC508; identical to SEQ ID NO: 5744

SEQ ID NO: 20729 - protein, 729 aa, Escherichia coli O157:H7 str. EC508; identical to SEQ ID NO: 5745

SEQ ID NO: 20730 - protein, 650 aa, Escherichia coli O157:H7 str. EC508; identical to SEQ ID NO: 11539

SEQ ID NO: 20731 - protein, 998 aa, Escherichia coli O157:H7 str. EC508; identical to SEQ ID NO: 5657

SEQ ID NO: 20732 - protein, 224 aa, Escherichia coli O157:H7 str. EC508; identical to SEQ ID NO: 11374

SEQ ID NO: 20733 - protein, 208 aa, Escherichia coli O157:H7 str. EC508; identical to SEQ ID NO: 5717

SEQ ID NO: 20734 - protein, 432 aa, Escherichia coli O157:H7 str. EC508; identical to SEQ ID NO: 5727

SEQ ID NO: 20735 - protein, 478 aa, Escherichia coli O157:H7 str. EC869; identical to SEQ ID NO: 5711

SEQ ID NO: 20736 - protein, 368 aa, Escherichia coli O157:H7 str. EC869; identical to SEQ ID NO: 11425

SEQ ID NO: 20737 - protein, 241 aa, Escherichia coli O157:H7 str. EC869; identical to SEQ ID NO: 5709

SEQ ID NO: 20738 - protein, 863 aa, Escherichia coli O157:H7 str. EC869; identical to SEQ ID NO: 12113

SEQ ID NO: 20739 - protein, 816 aa, Escherichia coli O157:H7 str. EC869; identical to SEQ ID NO: 11428

SEQ ID NO: 20740 - protein, 227 aa, Escherichia coli O157:H7 str. EC869; identical to SEQ ID NO: 11429

SEQ ID NO: 20741 - protein, 784 aa, Escherichia coli O157:H7 str. EC869; identical to SEQ ID NO: 5705

SEQ ID NO: 20742 - protein, 446 aa, Escherichia coli O157:H7 str. EC869; identical to SEQ ID NO: 5714

SEQ ID NO: 20743 - protein, 237 aa, Escherichia coli O157:H7 str. EC869; identical to SEQ ID NO: 5713

SEQ ID NO: 20744 - protein, 412 aa, Escherichia coli O157:H7 str. EC869; identical to SEQ ID NO: 5719

SEQ ID NO: 20745 - protein, 660 aa, Escherichia coli O157:H7 str. EC869; identical to SEQ ID NO: 11731

SEQ ID NO: 20746 - protein, 229 aa, Escherichia coli O157:H7 str. EC869; identical to SEQ ID NO: 11418

SEQ ID NO: 20747 - protein, 512 aa, Escherichia coli O157:H7 str. EC869; identical to SEQ ID NO: 5948

SEQ ID NO: 20748 - protein, 567 aa, Escherichia coli O157:H7 str. EC869; identical to SEQ ID NO: 11409

SEQ ID NO: 20749 - protein, 359 aa, Escherichia coli O157:H7 str. EC869; identical to SEQ ID NO: 11410

SEQ ID NO: 20750 - protein, 713 aa, Escherichia coli O157:H7 str. EC869
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPHHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 20751 - protein, 231 aa, Escherichia coli O157:H7 str. EC869
MSKRTFAMIFTLLCSFCIGQALAGGIVLQRTRVIYDASRKEAALPVANKGAETPYLLQSWVDNIDGTSRAPFIITPPLIRLEAGDDSSLRIIKTADNLPENKESLFYINVRAIPAKKKSDDVNANELTLVFKTQIKMFYRPAHLKGRVSDAWKSLEFKRSDHSLNIYNPTEYYVVFAGLAVDKADLTSKIEYIAPGEHKQLPLPASGGKNVKWAAINDYGGSSGTETRPLQ

SEQ ID NO: 20752 - protein, 863 aa, Escherichia coli O157:H7 str. EC869; identical to SEQ ID NO: 19681

SEQ ID NO: 20753 - protein, 678 aa, Escherichia coli O157:H7 str. EC869; identical to SEQ ID NO: 5722

SEQ ID NO: 20754 - protein, 230 aa, Escherichia coli O157:H7 str. EC869; identical to SEQ ID NO: 5765

SEQ ID NO: 20755 - protein, 869 aa, Escherichia coli O157:H7 str. EC869; identical to SEQ ID NO: 5763

SEQ ID NO: 20756 - protein, 746 aa, Escherichia coli O157:H7 str. EC869; identical to SEQ ID NO: 5761

SEQ ID NO: 20757 - protein, 193 aa, Escherichia coli O157:H7 str. EC869; identical to SEQ ID NO: 5760

SEQ ID NO: 20758 - protein, 614 aa, Escherichia coli O157:H7 str. EC869; identical to SEQ ID NO: 5715

SEQ ID NO: 20759 - protein, 208 aa, Escherichia coli O157:H7 str. EC869; identical to SEQ ID NO: 12027

SEQ ID NO: 20760 - protein, 243 aa, Escherichia coli O157:H7 str. EC869; identical to SEQ ID NO: 11367

SEQ ID NO: 20761 - protein, 816 aa, Escherichia coli O157:H7 str. EC869; identical to SEQ ID NO: 11682

SEQ ID NO: 20762 - protein, 430 aa, Escherichia coli O157:H7 str. EC869; identical to SEQ ID NO: 5758

SEQ ID NO: 20763 - protein, 331 aa, Escherichia coli O157:H7 str. EC869; identical to SEQ ID NO: 6551

SEQ ID NO: 20764 - protein, 760 aa, Escherichia coli O157:H7 str. EC869; identical to SEQ ID NO: 5756

SEQ ID NO: 20765 - protein, 828 aa, Escherichia coli O157:H7 str. EC869; identical to SEQ ID NO: 5735

SEQ ID NO: 20766 - protein, 162 aa, Escherichia coli O157:H7 str. EC869; identical to SEQ ID NO: 5734

SEQ ID NO: 20767 - protein, 367 aa, Escherichia coli O157:H7 str. EC869; identical to SEQ ID NO: 5700

SEQ ID NO: 20768 - protein, 200 aa, Escherichia coli O157:H7 str. EC869; identical to SEQ ID NO: 5732

SEQ ID NO: 20769 - protein, 274 aa, Escherichia coli O157:H7 str. EC869; identical to SEQ ID NO: 5731

SEQ ID NO: 20770 - protein, 252 aa, Escherichia coli O157:H7 str. EC869; identical to SEQ ID NO: 11406

SEQ ID NO: 20771 - protein, 860 aa, Escherichia coli O157:H7 str. EC869; identical to SEQ ID NO: 12012

SEQ ID NO: 20772 - protein, 203 aa, Escherichia coli O157:H7 str. EC869; identical to SEQ ID NO: 6414

SEQ ID NO: 20773 - protein, 362 aa, Escherichia coli O157:H7 str. EC869; identical to SEQ ID NO: 5754

SEQ ID NO: 20774 - protein, 224 aa, Escherichia coli O157:H7 str. EC869; identical to SEQ ID NO: 11374

SEQ ID NO: 20775 - protein, 203 aa, Escherichia coli O157:H7 str. EC869; identical to SEQ ID NO: 6347

SEQ ID NO: 20776 - protein, 207 aa, Escherichia coli O157:H7 str. EC869; identical to SEQ ID NO: 5743

SEQ ID NO: 20777 - protein, 518 aa, Escherichia coli O157:H7 str. EC869; identical to SEQ ID NO: 11400

SEQ ID NO: 20778 - protein, 432 aa, Escherichia coli O157:H7 str. EC869; identical to SEQ ID NO: 5727

SEQ ID NO: 20779 - protein, 122 aa, Escherichia coli O157:H7 str. EC869; identical to SEQ ID NO: 5737

SEQ ID NO: 20780 - protein, 539 aa, Escherichia coli O157:H7 str. EC869; identical to SEQ ID NO: 12072

SEQ ID NO: 20781 - protein, 236 aa, Escherichia coli O157:H7 str. EC869; identical to SEQ ID NO: 11364

SEQ ID NO: 20782 - protein, 883 aa, Escherichia coli O157:H7 str. EC869; identical to SEQ ID NO: 5702

SEQ ID NO: 20783 - protein, 366 aa, Escherichia coli O157:H7 str. EC869; identical to SEQ ID NO: 11362

SEQ ID NO: 20784 - protein, 700 aa, Escherichia coli O157:H7 str. EC869; identical to SEQ ID NO: 5740

SEQ ID NO: 20785 - protein, 229 aa, Escherichia coli O157:H7 str. EC869; identical to SEQ ID NO: 11455

SEQ ID NO: 20786 - protein, 840 aa, Escherichia coli O157:H7 str. EC869; identical to SEQ ID NO: 11380

SEQ ID NO: 20787 - protein, 233 aa, Escherichia coli O157:H7 str. EC869; identical to SEQ ID NO: 11381

SEQ ID NO: 20788 - protein, 696 aa, Escherichia coli O157:H7 str. EC869; identical to SEQ ID NO: 6320

SEQ ID NO: 20789 - protein, 659 aa, Escherichia coli O157:H7 str. EC869; identical to SEQ ID NO: 5736

SEQ ID NO: 20790 - protein, 826 aa, Escherichia coli O157:H7 str. EC869; identical to SEQ ID NO: 11397

SEQ ID NO: 20791 - protein, 224 aa, Escherichia coli O157:H7 str. EC869; identical to SEQ ID NO: 12004

SEQ ID NO: 20792 - protein, 241 aa, Escherichia coli O157:H7 str. EC869; identical to SEQ ID NO: 11431

SEQ ID NO: 20793 - protein, 747 aa, Escherichia coli O157:H7 str. EC869; identical to SEQ ID NO: 5775

SEQ ID NO: 20794 - protein, 266 aa, Escherichia coli O157:H7 str. EC869; identical to SEQ ID NO: 5771

SEQ ID NO: 20795 - protein, 161 aa, Escherichia coli O157:H7 str. EC869; identical to SEQ ID NO: 5769

SEQ ID NO: 20796 - protein, 111 aa, Escherichia coli O157:H7 str. EC869; identical to SEQ ID NO: 5738

SEQ ID NO: 20797 - protein, 351 aa, Escherichia coli O157:H7 str. EC869; identical to SEQ ID NO: 5767

SEQ ID NO: 20798 - protein, 650 aa, Escherichia coli O157:H7 str. EC869; identical to SEQ ID NO: 11539

SEQ ID NO: 20799 - protein, 998 aa, Escherichia coli O157:H7 str. EC869; identical to SEQ ID NO: 6058

SEQ ID NO: 20800 - protein, 517 aa, Escherichia coli O157:H7 str. EC869; identical to SEQ ID NO: 6817

SEQ ID NO: 20801 - protein, 191 aa, Escherichia coli O157:H7 str. EC869; identical to SEQ ID NO: 5748

SEQ ID NO: 20802 - protein, 232 aa, Escherichia coli O157:H7 str. EC869; identical to SEQ ID NO: 5747

SEQ ID NO: 20803 - protein, 729 aa, Escherichia coli O157:H7 str. EC869; identical to SEQ ID NO: 5745

SEQ ID NO: 20804 - protein, 213 aa, Escherichia coli O157:H7 str. EC869; identical to SEQ ID NO: 5744

SEQ ID NO: 20805 - protein, 715 aa, Escherichia coli O157:H7 str. EC869; identical to SEQ ID NO: 11710

SEQ ID NO: 20806 - protein, 89 aa, Escherichia coli O157:H7 str. EC869; identical to SEQ ID NO: 6053

SEQ ID NO: 20807 - protein, 832 aa, Escherichia coli O157:H7 str. EC869
MAEPFSGAWQQGVKADPEAVLSFHAVFACISLISQDIAKMRLRLMQTDAHGIRRETRRGDIARLCRRPNAQQNRIQFFELWLNAKLRHGNTVVLKIRNARGQIKELRILDWSRVEPLVADDGEVFYRITPDRNCGITEAVTVPAREVIHDRFNCFFHPLIGLPPVYAAGLAATQGHHIQENSTSFFRNGGRPSGVIEIPGSITEENAKKLKSNWDSGYTGENAGKTAILSNGAKYNPTTFSPVDAQTVEQLKMTAEIVCSVFRVPAYKIGVGQPPSSDNVEALEQQYYSQCLQTLIESIELLLDEALETGENESTEFDVTTLLRMDSERRMKTLGDAVKNTLLTPNEARKRENLPPLAGGDALYLQQQNYSLEALSRRDAREDPFASAGKTVSSQLPDGASDGNKAISETEHDAVKAMFRGDTEKMTERELSIIRALGEEFSTVLADLQRTFEEKIAAQAQTFEEKLASQSVVLQKCVTGDDVRPMLEQMVKEAVSHIPVPRDGRDYDPDVLQKAVNDAVANIPVPADGKSITPDDVRPMLEQMVKEAVSHIPVPRDGRDYDPDVLQKAVNDAVAKIPVPADGKSITPDDVHPMLEQMVKEAVSHIPVPRDGRDYDPDVLQKAVNDAVAKIPVPADGKSITPDDVHPMLEQMVKEAVSHIPVPRDGRDYDPDVLQKAVLEAVSALPAPQDGRDATALEILPAIDDQKSFPRGSYATHQGGLWRAYEKTYGMRGWECLVDGVADIDVSMTDERLFSVVIRQSSGQCTEKTFSLPVMLYRGVFRAGKTYHPGDTVTWGGSLWHCNSMTGDKPGEAHSSAWTLAAKRGRDAGGGK

SEQ ID NO: 20808 - protein, 89 aa, Escherichia coli O157:H7 str. EC869; identical to SEQ ID NO: 6232

SEQ ID NO: 20809 - protein, 227 aa, Escherichia coli O157:H7 str. G5101; identical to SEQ ID NO: 11429

SEQ ID NO: 20810 - protein, 784 aa, Escherichia coli O157:H7 str. G5101; identical to SEQ ID NO: 19272

SEQ ID NO: 20811 - protein, 170 aa, Escherichia coli O157:H7 str. G5101; identical to SEQ ID NO: 5855

SEQ ID NO: 20812 - protein, 816 aa, Escherichia coli O157:H7 str. G5101; identical to SEQ ID NO: 11428

SEQ ID NO: 20813 - protein, 111 aa, Escherichia coli O157:H7 str. G5101; identical to SEQ ID NO: 5738

SEQ ID NO: 20814 - protein, 124 aa, Escherichia coli O157:H7 str. G5101
MYAEPRNMTGYGDADAIANKTQNFEVVAQYQFDFGLRPSIAYLQSKGKDLGGVNSDNFDSQGNHHYTNKDLVKYVDIGMTYYFNKNMSTYVDYKINLLDNDDDFYKENGIATDDIVAVGLVYQF

SEQ ID NO: 20815 - protein, 118 aa, Escherichia coli O157:H7 str. G5101 [sequence omitted]

SEQ ID NO: 20816 - protein, 715 aa, Escherichia coli O157:H7 str. G5101; identical to SEQ ID NO: 11710

SEQ ID NO: 20817 - protein, 75 aa, Escherichia coli O157:H7 str. G5101; identical to SEQ ID NO: 19279

SEQ ID NO: 20818 - protein, 659 aa, Escherichia coli O157:H7 str. G5101
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPSNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 20819 - protein, 828 aa, Escherichia coli O157:H7 str. G5101; identical to SEQ ID NO: 5735

SEQ ID NO: 20820 - protein, 162 aa, Escherichia coli O157:H7 str. G5101; identical to SEQ ID NO: 5734

SEQ ID NO: 20821 - protein, 367 aa, Escherichia coli O157:H7 str. G5101; identical to SEQ ID NO: 5700

SEQ ID NO: 20822 - protein, 200 aa, Escherichia coli O157:H7 str. G5101; identical to SEQ ID NO: 5732

SEQ ID NO: 20823 - protein, 274 aa, Escherichia coli O157:H7 str. G5101; identical to SEQ ID NO: 5730

SEQ ID NO: 20824 - protein, 252 aa, Escherichia coli O157:H7 str. G5101; identical to SEQ ID NO: 11406

SEQ ID NO: 20825 - protein, 879 aa, Escherichia coli O157:H7 str. G5101; identical to SEQ ID NO: 19287

SEQ ID NO: 20826 - protein, 518 aa, Escherichia coli O157:H7 str. G5101; identical to SEQ ID NO: 11400

SEQ ID NO: 20827 - protein, 359 aa, Escherichia coli O157:H7 str. G5101; identical to SEQ ID NO: 11410

SEQ ID NO: 20828 - protein, 432 aa, Escherichia coli O157:H7 str. G5101; identical to SEQ ID NO: 5727

SEQ ID NO: 20829 - protein, 567 aa, Escherichia coli O157:H7 str. G5101; identical to SEQ ID NO: 11409

SEQ ID NO: 20830 - protein, 713 aa, Escherichia coli O157:H7 str. G5101; identical to SEQ ID NO: 11726

SEQ ID NO: 20831 - protein, 231 aa, Escherichia coli O157:H7 str. G5101; identical to SEQ ID NO: 5724

SEQ ID NO: 20832 - protein, 678 aa, Escherichia coli O157:H7 str. G5101; identical to SEQ ID NO: 5722

SEQ ID NO: 20833 - protein, 241 aa, Escherichia coli O157:H7 str. G5101; identical to SEQ ID NO: 11431

SEQ ID NO: 20834 - protein, 747 aa, Escherichia coli O157:H7 str. G5101; identical to SEQ ID NO: 5775

SEQ ID NO: 20835 - protein, 266 aa, Escherichia coli O157:H7 str. G5101; identical to SEQ ID NO: 5772

SEQ ID NO: 20836 - protein, 161 aa, Escherichia coli O157:H7 str. G5101; identical to SEQ ID NO: 5769

SEQ ID NO: 20837 - protein, 412 aa, Escherichia coli O157:H7 str. G5101; identical to SEQ ID NO: 5719

SEQ ID NO: 20838 - protein, 660 aa, Escherichia coli O157:H7 str. G5101; identical to SEQ ID NO: 11731

SEQ ID NO: 20839 - protein, 228 aa, Escherichia coli O157:H7 str. G5101
MKSKFVALALSLFLSQSVLAGGVGLSSTRVIYDGSKKEASLTVQNKSKTEEFLIQSWMDDAAGSKKTPFIITPPLFKLDPEKNNILRIVNITPGLPQDRESVYWVNVKAIPSKSDDSENKNVLQIAVRTRIKLFYRPAGLKGDVKTAPNELRFTRNGNQLRVDNPTVFNITFNQFFANDKEIEKAGMVPAKGALNITLPAGVGSVSKIKYNTINDFGSSAEMITKNVD

SEQ ID NO: 20840 - protein, 108 aa, Escherichia coli O157:H7 str. G5101; identical to SEQ ID NO: 11583

SEQ ID NO: 20841 - protein, 512 aa, Escherichia coli O157:H7 str. G5101; identical to SEQ ID NO: 5948

SEQ ID NO: 20842 - protein, 208 aa, Escherichia coli O157:H7 str. G5101; identical to SEQ ID NO: 5717

SEQ ID NO: 20843 - protein, 614 aa, Escherichia coli O157:H7 str. G5101; identical to SEQ ID NO: 5716

SEQ ID NO: 20844 - protein, 445 aa, Escherichia coli O157:H7 str. G5101; identical to SEQ ID NO: 12556

SEQ ID NO: 20845 - protein, 237 aa, Escherichia coli O157:H7 str. G5101; identical to SEQ ID NO: 5713

SEQ ID NO: 20846 - protein, 478 aa, Escherichia coli O157:H7 str. G5101; identical to SEQ ID NO: 5711

SEQ ID NO: 20847 - protein, 368 aa, Escherichia coli O157:H7 str. G5101; identical to SEQ ID NO: 11425

SEQ ID NO: 20848 - protein, 241 aa, Escherichia coli O157:H7 str. G5101; identical to SEQ ID NO: 5709

SEQ ID NO: 20849 - protein, 878 aa, Escherichia coli O157:H7 str. G5101; identical to SEQ ID NO: 5706

SEQ ID NO: 20850 - protein, 230 aa, Escherichia coli O157:H7 str. G5101; identical to SEQ ID NO: 5765

SEQ ID NO: 20851 - protein, 869 aa, Escherichia coli O157:H7 str. G5101
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 20852 - protein, 351 aa, Escherichia coli O157:H7 str. G5101; identical to SEQ ID NO: 5767

SEQ ID NO: 20853 - protein, 746 aa, Escherichia coli O157:H7 str. G5101; identical to SEQ ID NO: 5761

SEQ ID NO: 20854 - protein, 193 aa, Escherichia coli O157:H7 str. G5101; identical to SEQ ID NO: 5760

SEQ ID NO: 20855 - protein, 243 aa, Escherichia coli O157:H7 str. G5101; identical to SEQ ID NO: 8524

SEQ ID NO: 20856 - protein, 816 aa, Escherichia coli O157:H7 str. G5101; identical to SEQ ID NO: 11682

SEQ ID NO: 20857 - protein, 430 aa, Escherichia coli O157:H7 str. G5101; identical to SEQ ID NO: 5758

SEQ ID NO: 20858 - protein, 331 aa, Escherichia coli O157:H7 str. G5101; identical to SEQ ID NO: 6551

SEQ ID NO: 20859 - protein, 760 aa, Escherichia coli O157:H7 str. G5101
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDAGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTATLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTASIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 20860 - protein, 203 aa, Escherichia coli O157:H7 str. G5101; identical to SEQ ID NO: 6414

SEQ ID NO: 20861 - protein, 362 aa, Escherichia coli O157:H7 str. G5101; identical to SEQ ID NO: 5754

SEQ ID NO: 20862 - protein, 233 aa, Escherichia coli O157:H7 str. G5101; identical to SEQ ID NO: 5752

SEQ ID NO: 20863 - protein, 173 aa, Escherichia coli O157:H7 str. G5101; identical to SEQ ID NO: 12052

SEQ ID NO: 20864 - protein, 517 aa, Escherichia coli O157:H7 str. G5101; identical to SEQ ID NO: 6817

SEQ ID NO: 20865 - protein, 191 aa, Escherichia coli O157:H7 str. G5101; identical to SEQ ID NO: 5748

SEQ ID NO: 20866 - protein, 232 aa, Escherichia coli O157:H7 str. G5101; identical to SEQ ID NO: 5747

SEQ ID NO: 20867 - protein, 729 aa, Escherichia coli O157:H7 str. G5101
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNSAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 20868 - protein, 213 aa, Escherichia coli O157:H7 str. G5101; identical to SEQ ID NO: 5744

SEQ ID NO: 20869 - protein, 229 aa, Escherichia coli O157:H7 str. G5101; identical to SEQ ID NO: 11455

SEQ ID NO: 20870 - protein, 840 aa, Escherichia coli O157:H7 str. G5101
MNKSVVSISAAMLVLLCQPVMGSEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAKELAPGITSQTQLSQLRLDLSVPQSQLISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQCLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTTVGLNASKGQDYWQASGNVQGAMAVHGGGITFGPYLGETFALIEAKGAEGAKVYNSSQLEINDSGYALVPAVTPYRYNRISLDPQGMDGDAELVDSERQVAPVAGAAVKVIFRTRPGKALLIKSRMADGSELPMGADVLDENNTVVGIAGQGGQIYLRTEQTKGHLSVRWGEGANDSCQLPFDISGKDSNSPIIRLNETCQS

SEQ ID NO: 20871 - protein, 233 aa, Escherichia coli O157:H7 str. G5101; identical to SEQ ID NO: 11381

SEQ ID NO: 20872 - protein, 203 aa, Escherichia coli O157:H7 str. G5101; identical to SEQ ID NO: 6347

SEQ ID NO: 20873 - protein, 656 aa, Escherichia coli O157:H7 str. G5101
MRLKKHYLCTALSLAFTQQAVAAQESDSLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSELGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFVNEDTLALSYYDRKRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFVEEGRNFWAGVEYTF

SEQ ID NO: 20874 - protein, 207 aa, Escherichia coli O157:H7 str. G5101; identical to SEQ ID NO: 5743

SEQ ID NO: 20875 - protein, 539 aa, Escherichia coli O157:H7 str. G5101
MAAVCGTSGIASLFSQAVFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 20876 - protein, 700 aa, Escherichia coli O157:H7 str. G5101; identical to SEQ ID NO: 5740

SEQ ID NO: 20877 - protein, 366 aa, Escherichia coli O157:H7 str. G5101; identical to SEQ ID NO: 11362

SEQ ID NO: 20878 - protein, 883 aa, Escherichia coli O157:H7 str. G5101; identical to SEQ ID NO: 5702

SEQ ID NO: 20879 - protein, 239 aa, Escherichia coli O157:H7 str. G5101; identical to SEQ ID NO: 12299

SEQ ID NO: 20880 - protein, 816 aa, Escherichia coli O157:H7 str. LSU-61; identical to SEQ ID NO: 11428

SEQ ID NO: 20881 - protein, 227 aa, Escherichia coli O157:H7 str. LSU-61; identical to SEQ ID NO: 11429

SEQ ID NO: 20882 - protein, 784 aa, Escherichia coli O157:H7 str. LSU-61; identical to SEQ ID NO: 19272

SEQ ID NO: 20883 - protein, 170 aa, Escherichia coli O157:H7 str. LSU-61; identical to SEQ ID NO: 5855

SEQ ID NO: 20884 - protein, 241 aa, Escherichia coli O157:H7 str. LSU-61; identical to SEQ ID NO: 11431

SEQ ID NO: 20885 - protein, 747 aa, Escherichia coli O157:H7 str. LSU-61; identical to SEQ ID NO: 5775

SEQ ID NO: 20886 - protein, 266 aa, Escherichia coli O157:H7 str. LSU-61; identical to SEQ ID NO: 5772

SEQ ID NO: 20887 - protein, 161 aa, Escherichia coli O157:H7 str. LSU-61; identical to SEQ ID NO: 5769

SEQ ID NO: 20888 - protein, 111 aa, Escherichia coli O157:H7 str. LSU-61; identical to SEQ ID NO: 5738

SEQ ID NO: 20889 - protein, 118 aa, Escherichia coli O157:H7 str. LSU-61 [sequence omitted]

SEQ ID NO: 20890 - protein, 395 aa, Escherichia coli O157:H7 str. LSU-61; identical to SEQ ID NO: 12302

SEQ ID NO: 20891 - protein, 715 aa, Escherichia coli O157:H7 str. LSU-61
MLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLGRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 20892 - protein, 75 aa, Escherichia coli O157:H7 str. LSU-61; identical to SEQ ID NO: 19279

SEQ ID NO: 20893 - protein, 659 aa, Escherichia coli O157:H7 str. LSU-61; identical to SEQ ID NO: 5736

SEQ ID NO: 20894 - protein, 828 aa, Escherichia coli O157:H7 str. LSU-61; identical to SEQ ID NO: 5735

SEQ ID NO: 20895 - protein, 162 aa, Escherichia coli O157:H7 str. LSU-61; identical to SEQ ID NO: 5734

SEQ ID NO: 20896 - protein, 367 aa, Escherichia coli O157:H7 str. LSU-61; identical to SEQ ID NO: 5700

SEQ ID NO: 20897 - protein, 200 aa, Escherichia coli O157:H7 str. LSU-61; identical to SEQ ID NO: 5732

SEQ ID NO: 20898 - protein, 274 aa, Escherichia coli O157:H7 str. LSU-61; identical to SEQ ID NO: 5730

SEQ ID NO: 20899 - protein, 252 aa, Escherichia coli O157:H7 str. LSU-61; identical to SEQ ID NO: 11406

SEQ ID NO: 20900 - protein, 879 aa, Escherichia coli O157:H7 str. LSU-61
MPDHSLFRLRVLPCCVALAMSGSYVNAWAENEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDITHSHTRLDKETAYGKGSLDGNSFRLSYSKDFDELNSRVTFAGYRFSEENFMTMSEYLDASDSEMVRTGNDKEMYTATYNQNFRDAGVSVYLNYTRHTYWDRDEQTNYNVMLSHYFNLGSIRNMSISMTGYRYEYDNQADKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQATLTEGAIGYRKFSVSSGQKAMAVLRLQDGSYPPFGAEVKNDSAQNVGLVDDDGNVYLAGVKPGEHMIVSWGGVAHCDIHLPDPLPADLFNGLLLPCQQTGAISPSMPHEIKPVIQEQTQQVMPTEAPVSVSAN

SEQ ID NO: 20901 - protein, 518 aa, Escherichia coli O157:H7 str. LSU-61
MKKLKINYLFIGILALLLAVALWPSIPWFGKADNRIAAIQARGELRVSTIHTPQTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFLRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMQDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 20902 - protein, 432 aa, Escherichia coli O157:H7 str. LSU-61; identical to SEQ ID NO: 5727

SEQ ID NO: 20903 - protein, 505 aa, Escherichia coli O157:H7 str. LSU-61
MKKQISGNFDLTEPYALIERLSAQMGLIWYDDGKAIYIYDSSEMRNALINLRKVSTNEFNNFLKKSGLYNSRYEIKGDGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 20904 - protein, 359 aa, Escherichia coli O157:H7 str. LSU-61; identical to SEQ ID NO: 11410

SEQ ID NO: 20905 - protein, 686 aa, Escherichia coli O157:H7 str. LSU-61; identical to SEQ ID NO: 6339

SEQ ID NO: 20906 - protein, 713 aa, Escherichia coli O157:H7 str. LSU-61; identical to SEQ ID NO: 11726

SEQ ID NO: 20907 - protein, 231 aa, Escherichia coli O157:H7 str. LSU-61; identical to SEQ ID NO: 5724

SEQ ID NO: 20908 - protein, 838 aa, Escherichia coli O157:H7 str. LSU-61
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYNFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQKNRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 20909 - protein, 678 aa, Escherichia coli O157:H7 str. LSU-61; identical to SEQ ID NO: 5722

SEQ ID NO: 20910 - protein, 660 aa, Escherichia coli O157:H7 str. LSU-61; identical to SEQ ID NO: 11731

SEQ ID NO: 20911 - protein, 228 aa, Escherichia coli O157:H7 str. LSU-61; identical to SEQ ID NO: 11499

SEQ ID NO: 20912 - protein, 412 aa, Escherichia coli O157:H7 str. LSU-61; identical to SEQ ID NO: 5719

SEQ ID NO: 20913 - protein, 512 aa, Escherichia coli O157:H7 str. LSU-61; identical to SEQ ID NO: 5948

SEQ ID NO: 20914 - protein, 101 aa, Escherichia coli O157:H7 str. LSU-61
MGELALFFYGDKPDTTISIFNKETNLPYLLQTWVDPFNKEDKSKPPFSVIPPVSRIEPQQEKILRILKTAGELPKDRESVFWLNVKNIPPSIDKKIPMFLR

SEQ ID NO: 20915 - protein, 208 aa, Escherichia coli O157:H7 str. LSU-61; identical to SEQ ID NO: 5717

SEQ ID NO: 20916 - protein, 614 aa, Escherichia coli O157:H7 str. LSU-61; identical to SEQ ID NO: 5716

SEQ ID NO: 20917 - protein, 445 aa, Escherichia coli O157:H7 str. LSU-61; identical to SEQ ID NO: 12556

SEQ ID NO: 20918 - protein, 237 aa, Escherichia coli O157:H7 str. LSU-61; identical to SEQ ID NO: 5713

SEQ ID NO: 20919 - protein, 478 aa, Escherichia coli O157:H7 str. LSU-61
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASLEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 20920 - protein, 368 aa, Escherichia coli O157:H7 str. LSU-61; identical to SEQ ID NO: 11425

SEQ ID NO: 20921 - protein, 241 aa, Escherichia coli O157:H7 str. LSU-61; identical to SEQ ID NO: 5709

SEQ ID NO: 20922 - protein, 878 aa, Escherichia coli O157:H7 str. LSU-61
MSYLNLRLYQRNTQCLHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARCTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 20923 - protein, 230 aa, Escherichia coli O157:H7 str. LSU-61; identical to SEQ ID NO: 5765

SEQ ID NO: 20924 - protein, 869 aa, Escherichia coli O157:H7 str. LSU-61; identical to SEQ ID NO: 20851

SEQ ID NO: 20925 - protein, 351 aa, Escherichia coli O157:H7 str. LSU-61; identical to SEQ ID NO: 5767

SEQ ID NO: 20926 - protein, 746 aa, Escherichia coli O157:H7 str. LSU-61; identical to SEQ ID NO: 5761

SEQ ID NO: 20927 - protein, 193 aa, Escherichia coli O157:H7 str. LSU-61; identical to SEQ ID NO: 5760

SEQ ID NO: 20928 - protein, 243 aa, Escherichia coli O157:H7 str. LSU-61; identical to SEQ ID NO: 8524

SEQ ID NO: 20929 - protein, 430 aa, Escherichia coli O157:H7 str. LSU-61; identical to SEQ ID NO: 5758

SEQ ID NO: 20930 - protein, 331 aa, Escherichia coli O157:H7 str. LSU-61; identical to SEQ ID NO: 6551

SEQ ID NO: 20931 - protein, 760 aa, Escherichia coli O157:H7 str. LSU-61; identical to SEQ ID NO: 5756

SEQ ID NO: 20932 - protein, 203 aa, Escherichia coli O157:H7 str. LSU-61; identical to SEQ ID NO: 6414

SEQ ID NO: 20933 - protein, 362 aa, Escherichia coli O157:H7 str. LSU-61; identical to SEQ ID NO: 5754

SEQ ID NO: 20934 - protein, 233 aa, Escherichia coli O157:H7 str. LSU-61; identical to SEQ ID NO: 5752

SEQ ID NO: 20935 - protein, 229 aa, Escherichia coli O157:H7 str. LSU-61
MALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRKSQGVQLTNPTPYYINLIQVSVNGKALSNVGVVPPKSQRQTSWCQAIAPCHVAWRAINDYGGLSAKKEQNLP

SEQ ID NO: 20936 - protein, 229 aa, Escherichia coli O157:H7 str. LSU-61; identical to SEQ ID NO: 11455

SEQ ID NO: 20937 - protein, 840 aa, Escherichia coli O157:H7 str. LSU-61
MNKSVVSISAAMLVLLCQPVMGSEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAKELAPGITSQTQLSQLRLDLSVPQSQLISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTTVGLNASKGQDYWQASGNVQGAMAVHGGGITFGPYLGETFALVEAKGAEGAKVYNSSQLEINDSGYALVPAVTPYRYNRISLDPQGMDGDAELVDSERQVAPVAGVAVKVIFRTRPGKALLIKSRMADGSELPMGADVLDENNTVVGIAGQGGQIYLRTEQTKGHLSVRWGEGANDSCQLPFDISGKDSNSPIIRLNETCQS

SEQ ID NO: 20938 - protein, 233 aa, Escherichia coli O157:H7 str. LSU-61
MNIFAYLLVLVFSMSMSSSAFASVVMTGTRIIFPGDAKEKTIQLRNTSDQPYIINIHVEDERGSDKNVPFMPTPQTFRMEAAAGQALRLLYTGNNLPQDRESVFWFSFSQLPYLNKNDKSQNQLILALTNRVKIFYRPSSIVGKSSDAPKNLTYQVKQNRIEVTNPTGYYVTIRAAELLNNGKKVPLANSVMIAPQSTTEWTLPSGISVAPGAQIHLMTVNDYGVNVTSEHAL

SEQ ID NO: 20939 - protein, 517 aa, Escherichia coli O157:H7 str. LSU-61; identical to SEQ ID NO: 6817

SEQ ID NO: 20940 - protein, 191 aa, Escherichia coli O157:H7 str. LSU-61; identical to SEQ ID NO: 5748

SEQ ID NO: 20941 - protein, 232 aa, Escherichia coli O157:H7 str. LSU-61; identical to SEQ ID NO: 5747

SEQ ID NO: 20942 - protein, 729 aa, Escherichia coli O157:H7 str. LSU-61; identical to SEQ ID NO: 5745

SEQ ID NO: 20943 - protein, 213 aa, Escherichia coli O157:H7 str. LSU-61; identical to SEQ ID NO: 5744

SEQ ID NO: 20944 - protein, 203 aa, Escherichia coli O157:H7 str. LSU-61; identical to SEQ ID NO: 6347

SEQ ID NO: 20945 - protein, 656 aa, Escherichia coli O157:H7 str. LSU-61; identical to SEQ ID NO: 11774

SEQ ID NO: 20946 - protein, 207 aa, Escherichia coli O157:H7 str. LSU-61; identical to SEQ ID NO: 5743

SEQ ID NO: 20947 - protein, 551 aa, Escherichia coli O157:H7 str. LSU-61; identical to SEQ ID NO: 5742

SEQ ID NO: 20948 - protein, 700 aa, Escherichia coli O157:H7 str. LSU-61; identical to SEQ ID NO: 5740

SEQ ID NO: 20949 - protein, 883 aa, Escherichia coli O157:H7 str. LSU-61; identical to SEQ ID NO: 5702

SEQ ID NO: 20950 - protein, 239 aa, Escherichia coli O157:H7 str. LSU-61; identical to SEQ ID NO: 12299

SEQ ID NO: 20951 - protein, 366 aa, Escherichia coli O157:H7 str. LSU-61; identical to SEQ ID NO: 11362

SEQ ID NO: 20952 - protein, 720 aa, Escherichia coli O157:H7 str. TW14588; identical to SEQ ID NO: 11368

SEQ ID NO: 20953 - protein, 243 aa, Escherichia coli O157:H7 str. TW14588; identical to SEQ ID NO: 11367

SEQ ID NO: 20954 - protein, 614 aa, Escherichia coli O157:H7 str. TW14588; identical to SEQ ID NO: 5715

SEQ ID NO: 20955 - protein, 193 aa, Escherichia coli O157:H7 str. TW14588; identical to SEQ ID NO: 5760

SEQ ID NO: 20956 - protein, 746 aa, Escherichia coli O157:H7 str. TW14588; identical to SEQ ID NO: 5761

SEQ ID NO: 20957 - protein, 869 aa, Escherichia coli O157:H7 str. TW14588; identical to SEQ ID NO: 5763

SEQ ID NO: 20958 - protein, 230 aa, Escherichia coli O157:H7 str. TW14588; identical to SEQ ID NO: 5765

SEQ ID NO: 20959 - protein, 208 aa, Escherichia coli O157:H7 str. TW14588; identical to SEQ ID NO: 5717

SEQ ID NO: 20960 - protein, 127 aa, Escherichia coli O157:H7 str. TW14588; identical to SEQ ID NO: 19633

SEQ ID NO: 20961 - protein, 512 aa, Escherichia coli O157:H7 str. TW14588; identical to SEQ ID NO: 5948

SEQ ID NO: 20962 - protein, 351 aa, Escherichia coli O157:H7 str. TW14588; identical to SEQ ID NO: 5767

SEQ ID NO: 20963 - protein, 161 aa, Escherichia coli O157:H7 str. TW14588; identical to SEQ ID NO: 5769

SEQ ID NO: 20964 - protein, 266 aa, Escherichia coli O157:H7 str. TW14588; identical to SEQ ID NO: 5771

SEQ ID NO: 20965 - protein, 747 aa, Escherichia coli O157:H7 str. TW14588; identical to SEQ ID NO: 5774

SEQ ID NO: 20966 - protein, 241 aa, Escherichia coli O157:H7 str. TW14588; identical to SEQ ID NO: 11431

SEQ ID NO: 20967 - protein, 229 aa, Escherichia coli O157:H7 str. TW14588; identical to SEQ ID NO: 11418

SEQ ID NO: 20968 - protein, 367 aa, Escherichia coli O157:H7 str. TW14588; identical to SEQ ID NO: 11417

SEQ ID NO: 20969 - protein, 660 aa, Escherichia coli O157:H7 str. TW14588; identical to SEQ ID NO: 20600

SEQ ID NO: 20970 - protein, 784 aa, Escherichia coli O157:H7 str. TW14588; identical to SEQ ID NO: 5705

SEQ ID NO: 20971 - protein, 227 aa, Escherichia coli O157:H7 str. TW14588; identical to SEQ ID NO: 11429

SEQ ID NO: 20972 - protein, 816 aa, Escherichia coli O157:H7 str. TW14588; identical to SEQ ID NO: 11428

SEQ ID NO: 20973 - protein, 412 aa, Escherichia coli O157:H7 str. TW14588; identical to SEQ ID NO: 5719

SEQ ID NO: 20974 - protein, 173 aa, Escherichia coli O157:H7 str. TW14588; identical to SEQ ID NO: 11376

SEQ ID NO: 20975 - protein, 630 aa, Escherichia coli O157:H7 str. TW14588; identical to SEQ ID NO: 11690

SEQ ID NO: 20976 - protein, 224 aa, Escherichia coli O157:H7 str. TW14588; identical to SEQ ID NO: 11374

SEQ ID NO: 20977 - protein, 362 aa, Escherichia coli O157:H7 str. TW14588; identical to SEQ ID NO: 5754

SEQ ID NO: 20978 - protein, 863 aa, Escherichia coli O157:H7 str. TW14588; identical to SEQ ID NO: 11427

SEQ ID NO: 20979 - protein, 241 aa, Escherichia coli O157:H7 str. TW14588; identical to SEQ ID NO: 5709

SEQ ID NO: 20980 - protein, 368 aa, Escherichia coli O157:H7 str. TW14588; identical to SEQ ID NO: 11425

SEQ ID NO: 20981 - protein, 203 aa, Escherichia coli O157:H7 str. TW14588; identical to SEQ ID NO: 6414

SEQ ID NO: 20982 - protein, 760 aa, Escherichia coli O157:H7 str. TW14588; identical to SEQ ID NO: 5756

SEQ ID NO: 20983 - protein, 331 aa, Escherichia coli O157:H7 str. TW14588; identical to SEQ ID NO: 6551

SEQ ID NO: 20984 - protein, 430 aa, Escherichia coli O157:H7 str. TW14588; identical to SEQ ID NO: 5758

SEQ ID NO: 20985 - protein, 478 aa, Escherichia coli O157:H7 str. TW14588; identical to SEQ ID NO: 5711

SEQ ID NO: 20986 - protein, 237 aa, Escherichia coli O157:H7 str. TW14588; identical to SEQ ID NO: 5713

SEQ ID NO: 20987 - protein, 446 aa, Escherichia coli O157:H7 str. TW14588; identical to SEQ ID NO: 5714

SEQ ID NO: 20988 - protein, 567 aa, Escherichia coli O157:H7 str. TW14588; identical to SEQ ID NO: 11409

SEQ ID NO: 20989 - protein, 432 aa, Escherichia coli O157:H7 str. TW14588; identical to SEQ ID NO: 5727

SEQ ID NO: 20990 - protein, 518 aa, Escherichia coli O157:H7 str. TW14588; identical to SEQ ID NO: 11400

SEQ ID NO: 20991 - protein, 89 aa, Escherichia coli O157:H7 str. TW14588; identical to SEQ ID NO: 6233

SEQ ID NO: 20992 - protein, 860 aa, Escherichia coli O157:H7 str. TW14588; identical to SEQ ID NO: 11407

SEQ ID NO: 20993 - protein, 252 aa, Escherichia coli O157:H7 str. TW14588; identical to SEQ ID NO: 11406

SEQ ID NO: 20994 - protein, 274 aa, Escherichia coli O157:H7 str. TW14588; identical to SEQ ID NO: 5731

SEQ ID NO: 20995 - protein, 200 aa, Escherichia coli O157:H7 str. TW14588; identical to SEQ ID NO: 5732

SEQ ID NO: 20996 - protein, 367 aa, Escherichia coli O157:H7 str. TW14588; identical to SEQ ID NO: 5700

SEQ ID NO: 20997 - protein, 162 aa, Escherichia coli O157:H7 str. TW14588; identical to SEQ ID NO: 5734

SEQ ID NO: 20998 - protein, 828 aa, Escherichia coli O157:H7 str. TW14588; identical to SEQ ID NO: 5735

SEQ ID NO: 20999 - protein, 678 aa, Escherichia coli O157:H7 str. TW14588; identical to SEQ ID NO: 5722

SEQ ID NO: 21000 - protein, 863 aa, Escherichia coli O157:H7 str. TW14588; identical to SEQ ID NO: 19681

SEQ ID NO: 21001 - protein, 231 aa, Escherichia coli O157:H7 str. TW14588; identical to SEQ ID NO: 5724

SEQ ID NO: 21002 - protein, 627 aa, Escherichia coli O157:H7 str. TW14588
MVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNSGAAWQVTKDVKLRAGVLNLGDKDLSRDDYSYNEDGRRYFMAVDYRF

SEQ ID NO: 21003 - protein, 61 aa, Escherichia coli O157:H7 str. TW14588; identical to SEQ ID NO: 11399

SEQ ID NO: 21004 - protein, 713 aa, Escherichia coli O157:H7 str. TW14588; identical to SEQ ID NO: 11411

SEQ ID NO: 21005 - protein, 359 aa, Escherichia coli O157:H7 str. TW14588; identical to SEQ ID NO: 11410

SEQ ID NO: 21006 - protein, 213 aa, Escherichia coli O157:H7 str. TW14588; identical to SEQ ID NO: 5744

SEQ ID NO: 21007 - protein, 729 aa, Escherichia coli O157:H7 str. TW14588; identical to SEQ ID NO: 5745

SEQ ID NO: 21008 - protein, 232 aa, Escherichia coli O157:H7 str. TW14588; identical to SEQ ID NO: 5747

SEQ ID NO: 21009 - protein, 191 aa, Escherichia coli O157:H7 str. TW14588; identical to SEQ ID NO: 5748

SEQ ID NO: 21010 - protein, 517 aa, Escherichia coli O157:H7 str. TW14588; identical to SEQ ID NO: 6817

SEQ ID NO: 21011 - protein, 696 aa, Escherichia coli O157:H7 str. TW14588; identical to SEQ ID NO: 6320

SEQ ID NO: 21012 - protein, 233 aa, Escherichia coli O157:H7 str. TW14588; identical to SEQ ID NO: 11381

SEQ ID NO: 21013 - protein, 840 aa, Escherichia coli O157:H7 str. TW14588; identical to SEQ ID NO: 11380

SEQ ID NO: 21014 - protein, 229 aa, Escherichia coli O157:H7 str. TW14588; identical to SEQ ID NO: 11455

SEQ ID NO: 21015 - protein, 207 aa, Escherichia coli O157:H7 str. TW14588; identical to SEQ ID NO: 5743

SEQ ID NO: 21016 - protein, 656 aa, Escherichia coli O157:H7 str. TW14588; identical to SEQ ID NO: 11390

SEQ ID NO: 21017 - protein, 203 aa, Escherichia coli O157:H7 str. TW14588; identical to SEQ ID NO: 6347

SEQ ID NO: 21018 - protein, 191 aa, Escherichia coli O157:H7 str. TW14588; identical to SEQ ID NO: 5701

SEQ ID NO: 21019 - protein, 122 aa, Escherichia coli O157:H7 str. TW14588; identical to SEQ ID NO: 5737

SEQ ID NO: 21020 - protein, 132 aa, Escherichia coli O157:H7 str. TW14588; identical to SEQ ID NO: 20645

SEQ ID NO: 21021 - protein, 236 aa, Escherichia coli O157:H7 str. TW14588; identical to SEQ ID NO: 11364

SEQ ID NO: 21022 - protein, 871 aa, Escherichia coli O157:H7 str. TW14588; identical to SEQ ID NO: 11363

SEQ ID NO: 21023 - protein, 366 aa, Escherichia coli O157:H7 str. TW14588; identical to SEQ ID NO: 11362

SEQ ID NO: 21024 - protein, 700 aa, Escherichia coli O157:H7 str. TW14588; identical to SEQ ID NO: 5740

SEQ ID NO: 21025 - protein, 539 aa, Escherichia coli O157:H7 str. TW14588; identical to SEQ ID NO: 6525

SEQ ID NO: 21026 - protein, 407 aa, Escherichia coli O157:H7 str. TW14588
MTERELSIIRALGEEFSTVLADLQRTFEGKMAAQAQAFEEKLASLSAVLQKHVTVDEVHPVLQAMVDDAVGTIPVPRDGRDYDPDVLQQAVNDAVANIPVPADGKSITPDDVRPMLEQMVKEAVSHIPAPRDGRDYDPEVLKQAVNDAVANIPVPADGKSLTPDDVRPMLEQMVKEAVSHIPAPRDGRDYDPEVLKQAVNDAVANIPVPADGKSITPDDVRPMLEQMVKEAVSHIPVPRDGRDYDPDVLQKAVLDAVRALPAPQDGRDATALEIIPAIDDQKSFPRGTYATHQGGLWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRDAGGGK

SEQ ID NO: 21027 - protein, 715 aa, Escherichia coli O157:H7 str. TW14588; identical to SEQ ID NO: 11710

SEQ ID NO: 21028 - protein, 826 aa, Escherichia coli O157:H7 str. TW14588; identical to SEQ ID NO: 11397

SEQ ID NO: 21029 - protein, 224 aa, Escherichia coli O157:H7 str. TW14588; identical to SEQ ID NO: 11398

SEQ ID NO: 21030 - protein, 859 aa, Escherichia coli O157:H7 str. TW14588; identical to SEQ ID NO: 19623

SEQ ID NO: 21031 - protein, 998 aa, Escherichia coli O157:H7 str. TW14588; identical to SEQ ID NO: 6058

SEQ ID NO: 21032 - protein, 655 aa, Escherichia coli O157:H7 str. TW14588; identical to SEQ ID NO: 11466

SEQ ID NO: 21033 - protein, 656 aa, Escherichia coli O17:K52:H18; identical to SEQ ID NO: 7573
  strain UMN026 / ExPEC

SEQ ID NO: 21034 - protein, 753 aa, Escherichia coli O17:K52:H18; identical to SEQ ID NO: 5801
  strain UMN026 / ExPEC

SEQ ID NO: 21035 - protein, 119 aa, Escherichia coli O17:K52:H18; identical to SEQ ID NO: 5803
  strain UMN026 / ExPEC

SEQ ID NO: 21036 - protein, 362 aa, Escherichia coli O17:K52:H18; identical to SEQ ID NO: 5813
  strain UMN026 / ExPEC

SEQ ID NO: 21037 - protein, 203 aa, Escherichia coli O17:K52:H18; identical to SEQ ID NO: 6347
  strain UMN026 / ExPEC

SEQ ID NO: 21038 - protein, 663 aa, Escherichia coli O17:K52:H18
  strain UMN026 / ExPEC
MLNGIYSMRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEANLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTITAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 21039 - protein, 565 aa, Escherichia coli O17:K52:H18; identical to SEQ ID NO: 14768
  strain UMN026 / ExPEC

SEQ ID NO: 21040 - protein, 207 aa, Escherichia coli O17:K52:H18; identical to SEQ ID NO: 5743
  strain UMN026 / ExPEC

SEQ ID NO: 21041 - protein, 541 aa, Escherichia coli O17:K52:H18; identical to SEQ ID NO: 6286
  strain UMN026 / ExPEC

SEQ ID NO: 21042 - protein, 700 aa, Escherichia coli O17:K52:H18; identical to SEQ ID NO: 14775
  strain UMN026 / ExPEC

SEQ ID NO: 21043 - protein, 366 aa, Escherichia coli O17:K52:H18; identical to SEQ ID NO: 7432
  strain UMN026 / ExPEC

SEQ ID NO: 21044 - protein, 883 aa, Escherichia coli O17:K52:H18; identical to SEQ ID NO: 14848
  strain UMN026 / ExPEC

SEQ ID NO: 21045 - protein, 239 aa, Escherichia coli O17:K52:H18
  strain UMN026 / ExPEC
MHQMQTTRTPYSISFMATVLLLLLFACHSTIANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 21046 - protein, 828 aa, Escherichia coli O17:K52:H18; identical to SEQ ID NO: 6558
  strain UMN026 / ExPEC

SEQ ID NO: 21047 - protein, 162 aa, Escherichia coli O17:K52:H18; identical to SEQ ID NO: 5896
  strain UMN026 / ExPEC

SEQ ID NO: 21048 - protein, 367 aa, Escherichia coli O17:K52:H18; identical to SEQ ID NO: 14784
  strain UMN026 / ExPEC

SEQ ID NO: 21049 - protein, 200 aa, Escherichia coli O17:K52:H18; identical to SEQ ID NO: 7474
  strain UMN026 / ExPEC

SEQ ID NO: 21050 - protein, 274 aa, Escherichia coli O17:K52:H18; identical to SEQ ID NO: 8098
  strain UMN026 / ExPEC

SEQ ID NO: 21051 - protein, 249 aa, Escherichia coli O17:K52:H18; identical to SEQ ID NO: 8118
  strain UMN026 / ExPEC

SEQ ID NO: 21052 - protein, 883 aa, Escherichia coli O17:K52:H18; identical to SEQ ID NO: 16895
  strain UMN026 / ExPEC

SEQ ID NO: 21053 - protein, 472 aa, Escherichia coli O17:K52:H18; identical to SEQ ID NO: 5729
  strain UMN026 / ExPEC

SEQ ID NO: 21054 - protein, 432 aa, Escherichia coli O17:K52:H18; identical to SEQ ID NO: 5727
  strain UMN026 / ExPEC

SEQ ID NO: 21055 - protein, 567 aa, Escherichia coli O17:K52:H18; identical to SEQ ID NO: 6075
  strain UMN026 / ExPEC

SEQ ID NO: 21056 - protein, 359 aa, Escherichia coli O17:K52:H18; identical to SEQ ID NO: 6332
  strain UMN026 / ExPEC

SEQ ID NO: 21057 - protein, 816 aa, Escherichia coli O17:K52:H18; identical to SEQ ID NO: 14730
  strain UMN026 / ExPEC

SEQ ID NO: 21058 - protein, 227 aa, Escherichia coli O17:K52:H18; identical to SEQ ID NO: 8084
  strain UMN026 / ExPEC

SEQ ID NO: 21059 - protein, 784 aa, Escherichia coli O17:K52:H18; identical to SEQ ID NO: 6283
  strain UMN026 / ExPEC

SEQ ID NO: 21060 - protein, 170 aa, Escherichia coli O17:K52:H18; identical to SEQ ID NO: 5855
  strain UMN026 / ExPEC

SEQ ID NO: 21061 - protein, 891 aa, Escherichia coli O17:K52:H18; identical to SEQ ID NO: 16933
  strain UMN026 / ExPEC

SEQ ID NO: 21062 - protein, 243 aa, Escherichia coli O17:K52:H18; identical to SEQ ID NO: 14735
  strain UMN026 / ExPEC

SEQ ID NO: 21063 - protein, 752 aa, Escherichia coli O17:K52:H18; identical to SEQ ID NO: 7439
  strain UMN026 / ExPEC

SEQ ID NO: 21064 - protein, 266 aa, Escherichia coli O17:K52:H18; identical to SEQ ID NO: 8089
  strain UMN026 / ExPEC

SEQ ID NO: 21065 - protein, 810 aa, Escherichia coli O17:K52:H18; identical to SEQ ID NO: 6345
  strain UMN026 / ExPEC

SEQ ID NO: 21066 - protein, 161 aa, Escherichia coli O17:K52:H18; identical to SEQ ID NO: 5769
  strain UMN026 / ExPEC

SEQ ID NO: 21067 - protein, 221 aa, Escherichia coli O17:K52:H18; identical to SEQ ID NO: 6115
  strain UMN026 / ExPEC

SEQ ID NO: 21068 - protein, 371 aa, Escherichia coli O17:K52:H18
  strain UMN026 / ExPEC
MPESAMQNWIKAAAIAVSLALPGVALAQSLESLVNVQGVRENQLVGYSLVVGLDGTGDKNQVKFTNQTITNMLRQFGVQLPNKIDPKVKNVAAVAVSATLPPMYSRGQTIDVTVSSIGDAKSIRGGTLLLTQLHGADGEVYALAQGSVVVGGMNATGASGSSVTVNTPTAGLIPNGATVEREIPSDFQMGDTITLNLKRPSFKDANNIAAAINASFGGIATAQSSTNVTVRAPTSPGARVAFMSQLDDVQVQAEKIRARVVFNSRTGTVVMGDGIALHAAAVSHGSLTVSINETSNVSQPNAFAGGRTAVTPQSNIAVNHARPGVVSLPESSSLKTLVNALNSLGATPDDIMSILQALHEAGALDADLEVI

SEQ ID NO: 21069 - protein, 351 aa, Escherichia coli O17:K52:H18; identical to SEQ ID NO: 5767
  strain UMN026 / ExPEC

SEQ ID NO: 21070 - protein, 230 aa, Escherichia coli O17:K52:H18; identical to SEQ ID NO: 14749
  strain UMN026 / ExPEC

SEQ ID NO: 21071 - protein, 869 aa, Escherichia coli O17:K52:H18; identical to SEQ ID NO: 14750
  strain UMN026 / ExPEC

SEQ ID NO: 21072 - protein, 360 aa, Escherichia coli O17:K52:H18; identical to SEQ ID NO: 5879
  strain UMN026 / ExPEC

SEQ ID NO: 21073 - protein, 746 aa, Escherichia coli O17:K52:H18; identical to SEQ ID NO: 8052
  strain UMN026 / ExPEC

SEQ ID NO: 21074 - protein, 193 aa, Escherichia coli O17:K52:H18; identical to SEQ ID NO: 6300
  strain UMN026 / ExPEC

SEQ ID NO: 21075 - protein, 243 aa, Escherichia coli O17:K52:H18; identical to SEQ ID NO: 14754
  strain UMN026 / ExPEC

SEQ ID NO: 21076 - protein, 833 aa, Escherichia coli O17:K52:H18
  strain UMN026 / ExPEC
MAASSPPFFKYLSGMDTVNIYRLSFISCLVMAIPSALAVEFNLNVLDKSMRDRIDISLLKGKGGIAPGEYFVSVAVNNNQISNGQKIDWKKNGDQTIPCINDLLVDKFGLKPEVRQSLPRLNQCVDFSSRPEILFIFDQASQQLNITIPQAWLAWHSDNWTPPSTWKEGVAGVLMDYNLFASSYRPQDGSNSTNLNAYGTAGINAGAWRLRSDYQLNQTDSDDNHEQSGEISRTYLFRPLPQLGSKLTLGETDFSSNIFDGFSYTGAALASDDRMLPWELRGYAPQISGIAQTNATVTVSHSGRVIYQKKVPPGPFIIDDLNQSVQGTLDVKVTEEDGRVNNFQVSAASTPFLTRQGQVRYKLAAGQPRTSMSHQTENETFFSNEVSWGMLSNTSLYGGLLISGDNYHSAAMGIGQNMLWLGALSFDVTWASSQFDTQQDERGLSYRFNYSKQVDATNSTISLAAYRFSDRHFHSYANYLDHKYNDNDAQDEKQTISLSVGQPITPLNLNLYANLLHQTWWNADASTTANITAGFNVDIGNWRDISISTSFNTTHYEDKDRDNQIYLSISLPFGNGGRVGYDMQNSNHSTTHRMSWNDTLDERNSWGMSTGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVADNVIKETWIEGAIGYKSLASRSGKDVNLIIRNASGQFPPLGADIRQEDSGISVGMVGEEGHAWLSGVAENQQFTVIWGDSQRCSIHLPEHMEDTANRLILPCH

SEQ ID NO: 21077 - protein, 430 aa, Escherichia coli O17:K52:H18; identical to SEQ ID NO: 5758
  strain UMN026 / ExPEC

SEQ ID NO: 21078 - protein, 332 aa, Escherichia coli O17:K52:H18; identical to SEQ ID NO: 5757
  strain UMN026 / ExPEC

SEQ ID NO: 21079 - protein, 760 aa, Escherichia coli O17:K52:H18; identical to SEQ ID NO: 8074
  strain UMN026 / ExPEC

SEQ ID NO: 21080 - protein, 204 aa, Escherichia coli O17:K52:H18; identical to SEQ ID NO: 5755
  strain UMN026 / ExPEC

SEQ ID NO: 21081 - protein, 110 aa, Escherichia coli O17:K52:H18; identical to SEQ ID NO: 17794
  strain UMN026 / ExPEC

SEQ ID NO: 21082 - protein, 511 aa, Escherichia coli O17:K52:H18; identical to SEQ ID NO: 5749
  strain UMN026 / ExPEC

SEQ ID NO: 21083 - protein, 191 aa, Escherichia coli O17:K52:H18; identical to SEQ ID NO: 14762
  strain UMN026 / ExPEC

SEQ ID NO: 21084 - protein, 232 aa, Escherichia coli O17:K52:H18; identical to SEQ ID NO: 5747
  strain UMN026 / ExPEC

SEQ ID NO: 21085 - protein, 365 aa, Escherichia coli O17:K52:H18
  strain UMN026 / ExPEC
MIKFLSALILLLVTTAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINSRTGSVVMNREVTLDSCAVAQGNLSVTVNRQANVSQPDTPFGGGQTVVTPQMQIDLRQSGGSLQSVRSSASLNNVVRALNALGATPMDLMSILQSMQSAGCLRAKLEII

SEQ ID NO: 21086 - protein, 729 aa, Escherichia coli O17:K52:H18; identical to SEQ ID NO: 8069
  strain UMN026 / ExPEC

SEQ ID NO: 21087 - protein, 213 aa, Escherichia coli O17:K52:H18; identical to SEQ ID NO: 5744
  strain UMN026 / ExPEC

SEQ ID NO: 21088 - protein, 102 aa, Escherichia coli O17:K52:H18
  strain UMN026 / ExPEC
MKKVLALVVAAAMGLSSAAFAAETATTPAPTATTTKAAPAKTTHHKKQHKAAPAQKAQAAKKHHKNAKTEQKAPEQKAQAAKKHAKKHSHQQPAKPAAQPAA

SEQ ID NO: 21089 - protein, 122 aa, Escherichia coli O17:K52:H18; identical to SEQ ID NO: 5737
  strain UMN026 / ExPEC

SEQ ID NO: 21090 - protein, 402 aa, Escherichia coli O17:K52:H18; identical to SEQ ID NO: 14771
  strain UMN026 / ExPEC

SEQ ID NO: 21091 - protein, 334 aa, Escherichia coli O17:K52:H18
  strain UMN026 / ExPEC
MKKNQFLKESDVTAESVFFMKRRQVLKALGISAAALSLPHAAHADLLSWFKGNDRPPAPAGKPLEFSKPAAWQNDLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRECPPTTWNLAAPDEYGFYANVNPHVDHPRWSQATERFIGSGGILDVQRQPTLLFNGYADQVASLYRGLDLRENF

SEQ ID NO: 21092 - protein, 673 aa, Escherichia coli O17:K52:H18; identical to SEQ ID NO: 6170
  strain UMN026 / ExPEC

SEQ ID NO: 21093 - protein, 826 aa, Escherichia coli O17:K52:H18; identical to SEQ ID NO: 8096
  strain UMN026 / ExPEC

SEQ ID NO: 21094 - protein, 224 aa, Escherichia coli O17:K52:H18; identical to SEQ ID NO: 14779
  strain UMN026 / ExPEC

SEQ ID NO: 21095 - protein, 659 aa, Escherichia coli O17:K52:H18; identical to SEQ ID NO: 14780
  strain UMN026 / ExPEC

SEQ ID NO: 21096 - protein, 244 aa, Escherichia coli O17:K52:H18; identical to SEQ ID NO: 6219
  strain UMN026 / ExPEC

SEQ ID NO: 21097 - protein, 843 aa, Escherichia coli O17:K52:H18; identical to SEQ ID NO: 14792
  strain UMN026 / ExPEC

SEQ ID NO: 21098 - protein, 696 aa, Escherichia coli O17:K52:H18; identical to SEQ ID NO: 14793
  strain UMN026 / ExPEC

SEQ ID NO: 21099 - protein, 759 aa, Escherichia coli O17:K52:H18
  strain UMN026 / ExPEC
MAQRQPEKTAAGGCCFNSLYNKYSGITMMRKKYMPRALGPLLLVVLSPAVAQQNDDNEIIVSASRSNRTVAEMAQTTWVIENAELEQQIQGGKELKDALAQLIPGLDVSSQSRTNYGMNMRGRPLVVLIDGVRLNSSRSDSRQLDSVDPFNIDHIEVISGATALYGGGSTGGLINIVTKKGQPETMMEFEAGTKSGFNSSKDHDERIAGAVSGGNDHISGRLSVAYQKFGGWFDGNGDATLLDNTQTGLQHSNRLDIMGTGTLNIDESRQLQLITQYYKSQGDDNYGLNLGKGFSAISGSSTPYVSKGLNSDRIPGTERHLISLQYSDSDFLRQELVGQVYYRDESLRFYPFPTVNANKQATAFSSSQQDTDQYGMKLTLNSQLMDGWQITWGLDAEHERFTSNQMFFDLAQASASGGLNNHKIYTTGRYPSYDITNLAAFLQSSYDINDIFTVSGGVRYQYTENRVDDFIDYTQQQKIAAGKAISADAIPGGSVDYDNFLFNAGLLMHITERQQAWFNFSQGVALPDPGKYYGRGIYGAAVNGHLPLTKSVNVSDSKLEGVKVDSYELGWRFTGDNLRTQIAAYYSLSNKSVERNKDLTISVKDDRRRIYGVEGAVDYLIPDTDWSTGVNFNVLKTESKVNGQWQKYDVKESSPSKATAYINWAPEPWSLRVQSTTSFDVSDAEGNDINGYTTVDFISSWQLPVGTLSFSVENLFDRDYTTVWGQRAPLYYSPGYGPASLYDYKGRGRTFGLNYSVLF

SEQ ID NO: 21100 - protein, 686 aa, Escherichia coli O17:K52:H18; identical to SEQ ID NO: 15667
  strain UMN026 / ExPEC

SEQ ID NO: 21101 - protein, 222 aa, Escherichia coli O17:K52:H18; identical to SEQ ID NO: 14796
  strain UMN026 / ExPEC

SEQ ID NO: 21102 - protein, 678 aa, Escherichia coli O17:K52:H18; identical to SEQ ID NO: 14797
  strain UMN026 / ExPEC

SEQ ID NO: 21103 - protein, 331 aa, Escherichia coli O17:K52:H18
  strain UMN026 / ExPEC
MELLCPAGNLPALKAAIENGADAVYIGLKDDTNARHFAGLNFTEKKLQEAVSFVHQHRRKLHIAINTFAHPDGYARWQRAVDMAAQLGADALILADLAMLEYAAERYPHIERHVSVQASATNEEAIHFYHRHFDVARVVLPRVLSIHQVKQLARVTPVPLEVFAFGSLCIMSEGRCYLSSYLTGESPNTVGACSPARFVRWQQTPQGLESRLNEVLIDRYQDGENAGYPTLCKGRYLVDGERYHALEEPTSLNTLELLPELMAANIASVKIEGRQRSPAYVSQVAKVWRQAIDRCKADPQNFVPQSAWMETLGSMSEGTQTTLGAYHRKWQ

SEQ ID NO: 21104 - protein, 412 aa, Escherichia coli O17:K52:H18; identical to SEQ ID NO: 14802
  strain UMN026 / ExPEC

SEQ ID NO: 21105 - protein, 267 aa, Escherichia coli O17:K52:H18; identical to SEQ ID NO: 6118
  strain UMN026 / ExPEC

SEQ ID NO: 21106 - protein, 250 aa, Escherichia coli O17:K52:H18; identical to SEQ ID NO: 6119
  strain UMN026 / ExPEC

SEQ ID NO: 21107 - protein, 660 aa, Escherichia coli O17:K52:H18; identical to SEQ ID NO: 8092
  strain UMN026 / ExPEC

SEQ ID NO: 21108 - protein, 243 aa, Escherichia coli O17:K52:H18; identical to SEQ ID NO: 14800
  strain UMN026 / ExPEC

SEQ ID NO: 21109 - protein, 208 aa, Escherichia coli O17:K52:H18; identical to SEQ ID NO: 5717
  strain UMN026 / ExPEC

SEQ ID NO: 21110 - protein, 614 aa, Escherichia coli O17:K52:H18; identical to SEQ ID NO: 14804
  strain UMN026 / ExPEC

SEQ ID NO: 21111 - protein, 446 aa, Escherichia coli O17:K52:H18; identical to SEQ ID NO: 6459
  strain UMN026 / ExPEC

SEQ ID NO: 21112 - protein, 237 aa, Escherichia coli O17:K52:H18; identical to SEQ ID NO: 6384
  strain UMN026 / ExPEC

SEQ ID NO: 21113 - protein, 478 aa, Escherichia coli O17:K52:H18; identical to SEQ ID NO: 14741
  strain UMN026 / ExPEC

SEQ ID NO: 21114 - protein, 774 aa, Escherichia coli O17:K52:H18; identical to SEQ ID NO: 6382
  strain UMN026 / ExPEC

SEQ ID NO: 21115 - protein, 368 aa, Escherichia coli O17:K52:H18; identical to SEQ ID NO: 6380
  strain UMN026 / ExPEC

SEQ ID NO: 21116 - protein, 241 aa, Escherichia coli O17:K52:H18; identical to SEQ ID NO: 6143
  strain UMN026 / ExPEC

SEQ ID NO: 21117 - protein, 878 aa, Escherichia coli O17:K52:H18; identical to SEQ ID NO: 6669
  strain UMN026 / ExPEC

SEQ ID NO: 21118 - protein, 784 aa, Escherichia coli O18:K1:H7; identical to SEQ ID NO: 6829
  strain IHE3034 / ExPEC

SEQ ID NO: 21119 - protein, 862 aa, Escherichia coli O18:K1:H7; identical to SEQ ID NO: 7497
  strain IHE3034 / ExPEC

SEQ ID NO: 21120 - protein, 246 aa, Escherichia coli O18:K1:H7; identical to SEQ ID NO: 5857
  strain IHE3034 / ExPEC

SEQ ID NO: 21121 - protein, 747 aa, Escherichia coli O18:K1:H7; identical to SEQ ID NO: 7499
  strain IHE3034 / ExPEC

SEQ ID NO: 21122 - protein, 266 aa, Escherichia coli O18:K1:H7; identical to SEQ ID NO: 7500
  strain IHE3034 / ExPEC

SEQ ID NO: 21123 - protein, 161 aa, Escherichia coli O18:K1:H7; identical to SEQ ID NO: 5769
  strain IHE3034 / ExPEC

SEQ ID NO: 21124 - protein, 351 aa, Escherichia coli O18:K1:H7; identical to SEQ ID NO: 7560
  strain IHE3034 / ExPEC

SEQ ID NO: 21125 - protein, 746 aa, Escherichia coli O18:K1:H7; identical to SEQ ID NO: 6783
  strain IHE3034 / ExPEC

SEQ ID NO: 21126 - protein, 193 aa, Escherichia coli O18:K1:H7; identical to SEQ ID NO: 6300
  strain IHE3034 / ExPEC

SEQ ID NO: 21127 - protein, 472 aa, Escherichia coli O18:K1:H7; identical to SEQ ID NO: 7376
  strain IHE3034 / ExPEC

SEQ ID NO: 21128 - protein, 430 aa, Escherichia coli O18:K1:H7; identical to SEQ ID NO: 5758
  strain IHE3034 / ExPEC

SEQ ID NO: 21129 - protein, 331 aa, Escherichia coli O18:K1:H7; identical to SEQ ID NO: 7536
  strain IHE3034 / ExPEC

SEQ ID NO: 21130 - protein, 760 aa, Escherichia coli O18:K1:H7; identical to SEQ ID NO: 7535
  strain IHE3034 / ExPEC

SEQ ID NO: 21131 - protein, 203 aa, Escherichia coli O18:K1:H7; identical to SEQ ID NO: 6414
  strain IHE3034 / ExPEC

SEQ ID NO: 21132 - protein, 362 aa, Escherichia coli O18:K1:H7; identical to SEQ ID NO: 5874
  strain IHE3034 / ExPEC

SEQ ID NO: 21133 - protein, 432 aa, Escherichia coli O18:K1:H7; identical to SEQ ID NO: 5727
  strain IHE3034 / ExPEC

SEQ ID NO: 21134 - protein, 231 aa, Escherichia coli O18:K1:H7; identical to SEQ ID NO: 7521
  strain IHE3034 / ExPEC

SEQ ID NO: 21135 - protein, 876 aa, Escherichia coli O18:K1:H7; identical to SEQ ID NO: 7520
  strain IHE3034 / ExPEC

SEQ ID NO: 21136 - protein, 725 aa, Escherichia coli O18:K1:H7; identical to SEQ ID NO: 17714
  strain IHE3034 / ExPEC

SEQ ID NO: 21137 - protein, 654 aa, Escherichia coli O18:K1:H7
  strain IHE3034 / ExPEC
MNVIRTVICTLIILPVGLQAATSHSSMVKDTITIVATGNQNTVFETPSMVSVVTNDTPWSQNAVTSAGMLKGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGERAPNKEKPAALFAKGSVGITDSNKAGASLRLYRNNTTEPGNSTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTDNDRLQLKGGYFGTDARNYIATRVDMKRMRSYSYNVSRARIWGWDMQGNYQSDYVDWMLSYNRTESMDASSREWLGSGNPDTLISDISIPFGHRGVYAGWRAELSASATHVKKGDPHQAGYTIHSFSLSYKPVSVKGFEASVTLDNAFNKLAMNGKGVPLSGRTVSLYTRYQW

SEQ ID NO: 21138 - protein, 359 aa, Escherichia coli O18:K1:H7; identical to SEQ ID NO: 5847
  strain IHE3034 / ExPEC

SEQ ID NO: 21139 - protein, 511 aa, Escherichia coli O18:K1:H7; identical to SEQ ID NO: 5749
  strain IHE3034 / ExPEC

SEQ ID NO: 21140 - protein, 191 aa, Escherichia coli O18:K1:H7; identical to SEQ ID NO: 5748
  strain IHE3034 / ExPEC

SEQ ID NO: 21141 - protein, 232 aa, Escherichia coli O18:K1:H7; identical to SEQ ID NO: 5747
  strain IHE3034 / ExPEC

SEQ ID NO: 21142 - protein, 365 aa, Escherichia coli O18:K1:H7; identical to SEQ ID NO: 6335
  strain IHE3034 / ExPEC

SEQ ID NO: 21143 - protein, 729 aa, Escherichia coli O18:K1:H7; identical to SEQ ID NO: 6821
  strain IHE3034 / ExPEC

SEQ ID NO: 21144 - protein, 213 aa, Escherichia coli O18:K1:H7; identical to SEQ ID NO: 5744
  strain IHE3034 / ExPEC

SEQ ID NO: 21145 - protein, 360 aa, Escherichia coli O18:K1:H7; identical to SEQ ID NO: 5879
  strain IHE3034 / ExPEC

SEQ ID NO: 21146 - protein, 686 aa, Escherichia coli O18:K1:H7; identical to SEQ ID NO: 7542
  strain IHE3034 / ExPEC

SEQ ID NO: 21147 - protein, 713 aa, Escherichia coli O18:K1:H7; identical to SEQ ID NO: 6056
  strain IHE3034 / ExPEC

SEQ ID NO: 21148 - protein, 222 aa, Escherichia coli O18:K1:H7; identical to SEQ ID NO: 7531
  strain IHE3034 / ExPEC

SEQ ID NO: 21149 - protein, 840 aa, Escherichia coli O18:K1:H7; identical to SEQ ID NO: 7530
  strain IHE3034 / ExPEC

SEQ ID NO: 21150 - protein, 249 aa, Escherichia coli O18:K1:H7; identical to SEQ ID NO: 7529
  strain IHE3034 / ExPEC

SEQ ID NO: 21151 - protein, 656 aa, Escherichia coli O18:K1:H7; identical to SEQ ID NO: 7494
  strain IHE3034 / ExPEC

SEQ ID NO: 21152 - protein, 565 aa, Escherichia coli O18:K1:H7; identical to SEQ ID NO: 7493
  strain IHE3034 / ExPEC

SEQ ID NO: 21153 - protein, 207 aa, Escherichia coli O18:K1:H7; identical to SEQ ID NO: 7443
  strain IHE3034 / ExPEC

SEQ ID NO: 21154 - protein, 678 aa, Escherichia coli O18:K1:H7; identical to SEQ ID NO: 7525
  strain IHE3034 / ExPEC

SEQ ID NO: 21155 - protein, 654 aa, Escherichia coli O18:K1:H7; identical to SEQ ID NO: 6816
  strain IHE3034 / ExPEC

SEQ ID NO: 21156 - protein, 900 aa, Escherichia coli O18:K1:H7; identical to SEQ ID NO: 7567
  strain IHE3034 / ExPEC

SEQ ID NO: 21157 - protein, 551 aa, Escherichia coli O18:K1:H7; identical to SEQ ID NO: 5885
  strain IHE3034 / ExPEC

SEQ ID NO: 21158 - protein, 700 aa, Escherichia coli O18:K1:H7; identical to SEQ ID NO: 7559
  strain IHE3034 / ExPEC

SEQ ID NO: 21159 - protein, 883 aa, Escherichia coli O18:K1:H7
  strain IHE3034 / ExPEC
MTAFRAAFKAYRMHQVLILPRFARLTFALGLATAVFPVDAEYYFNPRFLSNDLAESVDLSAFTKGREAPPGTYRVDIYLNDEFMASRDITFIADDNNADLIPCLSTDLLVSLGIKKSALLDNKEHSADKHVPDNSACTPLQDRLADASSEFDVGQQHLSLSVPQIYVGRMAHGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGNLQVTIKEADGSIQTLYVPYSSVPVLQRAGYTRYALAMGEYRSGNNLQSTPKFVQASLMHGLKGNWTPYGGMQIAEDYQAFNLGIGKDLGLFGAFSFDITQANTTLADDTRHSGQSVKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFHNSNASYSMSNDLKGGMTNLSGVYGTLLPDNNLNYSVQVGNTQGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVDYKLPVVSPGTLLNQQTAICR

SEQ ID NO: 21160 - protein, 236 aa, Escherichia coli O18:K1:H7; identical to SEQ ID NO: 7624
  strain IHE3034 / ExPEC

SEQ ID NO: 21161 - protein, 412 aa, Escherichia coli O18:K1:H7; identical to SEQ ID NO: 7596
  strain IHE3034 / ExPEC

SEQ ID NO: 21162 - protein, 266 aa, Escherichia coli O18:K1:H7; identical to SEQ ID NO: 7595
  strain IHE3034 / ExPEC

SEQ ID NO: 21163 - protein, 250 aa, Escherichia coli O18:K1:H7; identical to SEQ ID NO: 5862
  strain IHE3034 / ExPEC

SEQ ID NO: 21164 - protein, 111 aa, Escherichia coli O18:K1:H7; identical to SEQ ID NO: 5889
  strain IHE3034 / ExPEC

SEQ ID NO: 21165 - protein, 660 aa, Escherichia coli O18:K1:H7; identical to SEQ ID NO: 6109
  strain IHE3034 / ExPEC

SEQ ID NO: 21166 - protein, 118 aa, Escherichia coli O18:K1:H7 [sequence omitted]

SEQ ID NO: 21167 - protein, 360 aa, Escherichia coli O18:K1:H7; identical to SEQ ID NO: 5891
  strain IHE3034 / ExPEC

SEQ ID NO: 21168 - protein, 334 aa, Escherichia coli O18:K1:H7; identical to SEQ ID NO: 7534
  strain IHE3034 / ExPEC

SEQ ID NO: 21169 - protein, 673 aa, Escherichia coli O18:K1:H7; identical to SEQ ID NO: 6170
  strain IHE3034 / ExPEC

SEQ ID NO: 21170 - protein, 715 aa, Escherichia coli O18:K1:H7; identical to SEQ ID NO: 6806
  strain IHE3034 / ExPEC

SEQ ID NO: 21171 - protein, 711 aa, Escherichia coli O18:K1:H7
  strain IHE3034 / ExPEC
MPALASFIPLHAHASSTSEDEMIVTGNTAADTTDSAAGAGFKTNDIDVGPLGTKSWIETPYSSTTVTKEMIENQQAQSVSEMLKYSPSTQMQARGGMDVGRPQSRGMQGSVVANSRLDGLNIVSTTAFPVEMLERMDVLNSLTGALYGPASPAGQFNFVAKRPTEETLRKVTLGYQSRSAFTGHADLGGHFDENKRFGYRVNLLDQEGEGNVDDSTLRRKLVSVALDWNIQPGTQLQLDASHYEFIQKGYVGSFNYGPNVKLPSAPNPKDKNLALSTAGNDLTTDTISTRLIHYFNDDWSMNAGVGWQQADRAMRSVSSKILNNQGDISRSMKDSTAAGRFRVLSNTAGLNGHIDTGSIGHDLSLSTTGYVWSLYSAKGTGSSYSWGTTNMYHPDAIDEQGDGKIRTGGPRYRSSVNTQQSVTLGDTVTFTPQWSAMFYLSQSWLQTKNYDKHGNQTNQVDENGLSPNAALMYKITPNTMAYVSYADSLEQGGTAPTDESVKNAGQTLNPYRSKQYEVGLKSDIGEMNLGAALFRLERPFAYLDTDNVYKEQGNQVNNGLELTAAGNVWQGLNIYSGVTFLDPKLKDTANASTSNKQVVGVPKVQANLLAEYSLPSIPEWVYSANVHYTGKRAANDTNTSYASSYTTWDLGTRYTTKVSNVPTTFRVVVNNVFDKHYWASIFPSGTDGDNGSPSAFIGGGREVRASVTFDF

SEQ ID NO: 21172 - protein, 208 aa, Escherichia coli O18:K1:H7; identical to SEQ ID NO: 5869
  strain IHE3034 / ExPEC

SEQ ID NO: 21173 - protein, 826 aa, Escherichia coli O18:K1:H7; identical to SEQ ID NO: 7523
  strain IHE3034 / ExPEC

SEQ ID NO: 21174 - protein, 224 aa, Escherichia coli O18:K1:H7; identical to SEQ ID NO: 5893
  strain IHE3034 / ExPEC

SEQ ID NO: 21175 - protein, 663 aa, Escherichia coli O18:K1:H7; identical to SEQ ID NO: 5894
  strain IHE3034 / ExPEC

SEQ ID NO: 21176 - protein, 446 aa, Escherichia coli O18:K1:H7; identical to SEQ ID NO: 5873
  strain IHE3034 / ExPEC

SEQ ID NO: 21177 - protein, 237 aa, Escherichia coli O18:K1:H7; identical to SEQ ID NO: 7546
  strain IHE3034 / ExPEC

SEQ ID NO: 21178 - protein, 478 aa, Escherichia coli O18:K1:H7; identical to SEQ ID NO: 6796
  strain IHE3034 / ExPEC

SEQ ID NO: 21179 - protein, 828 aa, Escherichia coli O18:K1:H7; identical to SEQ ID NO: 7510
  strain IHE3034 / ExPEC

SEQ ID NO: 21180 - protein, 162 aa, Escherichia coli O18:K1:H7; identical to SEQ ID NO: 8101
  strain IHE3034 / ExPEC

SEQ ID NO: 21181 - protein, 363 aa, Escherichia coli O18:K1:H7; identical to SEQ ID NO: 7508
  strain IHE3034 / ExPEC

SEQ ID NO: 21182 - protein, 200 aa, Escherichia coli O18:K1:H7; identical to SEQ ID NO: 5898
  strain IHE3034 / ExPEC

SEQ ID NO: 21183 - protein, 274 aa, Escherichia coli O18:K1:H7; identical to SEQ ID NO: 5899
  strain IHE3034 / ExPEC

SEQ ID NO: 21184 - protein, 250 aa, Escherichia coli O18:K1:H7; identical to SEQ ID NO: 7503
  strain IHE3034 / ExPEC

SEQ ID NO: 21185 - protein, 882 aa, Escherichia coli O18:K1:H7
  strain IHE3034 / ExPEC
MPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTVSMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 21186 - protein, 368 aa, Escherichia coli O18:K1:H7; identical to SEQ ID NO: 7561
  strain IHE3034 / ExPEC

SEQ ID NO: 21187 - protein, 241 aa, Escherichia coli O18:K1:H7; identical to SEQ ID NO: 6139
  strain IHE3034 / ExPEC

SEQ ID NO: 21188 - protein, 863 aa, Escherichia coli O18:K1:H7
  strain IHE3034 / ExPEC
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 21189 - protein, 195 aa, Escherichia coli O18:K1:H7
  strain IHE3034 / ExPEC
MKKKVLAIALVTVFTGTGVAQAADVTAQAVATWSATAKKDTTSKLVVTPLGSLAFQYAEGIKGFNSQKGLFDVAIEGDSTATAFKLTSRLITNTLTQLDTSGSTLNVGVDYNGAAVEKTGDTVMIDTANGVLGGNLSPLANGYNASNRTTAQDGFTFSIISGTTNGTTAVTDYSTLPEGIWSGDVSVQFDATWTS

SEQ ID NO: 21190 - protein, 998 aa, Escherichia coli O26:H-; identical to SEQ ID NO: 5650

SEQ ID NO: 21191 - protein, 432 aa, Escherichia coli O26:H11; identical to SEQ ID NO: 5727
  strain 11368 / EHEC

SEQ ID NO: 21192 - protein, 784 aa, Escherichia coli O26:H11; identical to SEQ ID NO: 6283
  strain 11368 / EHEC

SEQ ID NO: 21193 - protein, 170 aa, Escherichia coli O26:H11 [sequence omitted]

SEQ ID NO: 21194 - protein, 359 aa, Escherichia coli O26:H11; identical to SEQ ID NO: 5847
  strain 11368 / EHEC

SEQ ID NO: 21195 - protein, 696 aa, Escherichia coli O26:H11; identical to SEQ ID NO: 13547
  strain 11368 / EHEC

SEQ ID NO: 21196 - protein, 822 aa, Escherichia coli O26:H11; identical to SEQ ID NO: 8990
  strain 11368 / EHEC

SEQ ID NO: 21197 - protein, 249 aa, Escherichia coli O26:H11; identical to SEQ ID NO: 6450
  strain 11368 / EHEC

SEQ ID NO: 21198 - protein, 866 aa, Escherichia coli O26:H11; identical to SEQ ID NO: 7345
  strain 11368 / EHEC

SEQ ID NO: 21199 - protein, 246 aa, Escherichia coli O26:H11; identical to SEQ ID NO: 6342
  strain 11368 / EHEC

SEQ ID NO: 21200 - protein, 747 aa, Escherichia coli O26:H11; identical to SEQ ID NO: 8792
  strain 11368 / EHEC

SEQ ID NO: 21201 - protein, 266 aa, Escherichia coli O26:H11; identical to SEQ ID NO: 5772
  strain 11368 / EHEC

SEQ ID NO: 21202 - protein, 161 aa, Escherichia coli O26:H11; identical to SEQ ID NO: 5769
  strain 11368 / EHEC

SEQ ID NO: 21203 - protein, 366 aa, Escherichia coli O26:H11; identical to SEQ ID NO: 19006
  strain 11368 / EHEC

SEQ ID NO: 21204 - protein, 351 aa, Escherichia coli O26:H11; identical to SEQ ID NO: 8799
  strain 11368 / EHEC

SEQ ID NO: 21205 - protein, 231 aa, Escherichia coli O26:H11; identical to SEQ ID NO: 6351
  strain 11368 / EHEC

SEQ ID NO: 21206 - protein, 838 aa, Escherichia coli O26:H11; identical to SEQ ID NO: 8849
  strain 11368 / EHEC

SEQ ID NO: 21207 - protein, 678 aa, Escherichia coli O26:H11; identical to SEQ ID NO: 6353
  strain 11368 / EHEC

SEQ ID NO: 21208 - protein, 230 aa, Escherichia coli O26:H11; identical to SEQ ID NO: 7861
  strain 11368 / EHEC

SEQ ID NO: 21209 - protein, 869 aa, Escherichia coli O26:H11; identical to SEQ ID NO: 8801
  strain 11368 / EHEC

SEQ ID NO: 21210 - protein, 360 aa, Escherichia coli O26:H11; identical to SEQ ID NO: 8802
  strain 11368 / EHEC

SEQ ID NO: 21211 - protein, 412 aa, Escherichia coli O26:H11; identical to SEQ ID NO: 6495
  strain 11368 / EHEC

SEQ ID NO: 21212 - protein, 208 aa, Escherichia coli O26:H11; identical to SEQ ID NO: 5717
  strain 11368 / EHEC

SEQ ID NO: 21213 - protein, 746 aa, Escherichia coli O26:H11; identical to SEQ ID NO: 8803
  strain 11368 / EHEC

SEQ ID NO: 21214 - protein, 193 aa, Escherichia coli O26:H11; identical to SEQ ID NO: 6300
  strain 11368 / EHEC

SEQ ID NO: 21215 - protein, 243 aa, Escherichia coli O26:H11; identical to SEQ ID NO: 8805
  strain 11368 / EHEC

SEQ ID NO: 21216 - protein, 816 aa, Escherichia coli O26:H11; identical to SEQ ID NO: 8806
  strain 11368 / EHEC

SEQ ID NO: 21217 - protein, 430 aa, Escherichia coli O26:H11; identical to SEQ ID NO: 5758
  strain 11368 / EHEC

SEQ ID NO: 21218 - protein, 243 aa, Escherichia coli O26:H11; identical to SEQ ID NO: 6145
  strain 11368 / EHEC

SEQ ID NO: 21219 - protein, 332 aa, Escherichia coli O26:H11; identical to SEQ ID NO: 6321
  strain 11368 / EHEC

SEQ ID NO: 21220 - protein, 760 aa, Escherichia coli O26:H11; identical to SEQ ID NO: 6322
  strain 11368 / EHEC

SEQ ID NO: 21221 - protein, 204 aa, Escherichia coli O26:H11; identical to SEQ ID NO: 5755
  strain 11368 / EHEC

SEQ ID NO: 21222 - protein, 362 aa, Escherichia coli O26:H11; identical to SEQ ID NO: 5809
  strain 11368 / EHEC

SEQ ID NO: 21223 - protein, 233 aa, Escherichia coli O26:H11; identical to SEQ ID NO: 6327
  strain 11368 / EHEC

SEQ ID NO: 21224 - protein, 866 aa, Escherichia coli O26:H11; identical to SEQ ID NO: 6328
  strain 11368 / EHEC

SEQ ID NO: 21225 - protein, 236 aa, Escherichia coli O26:H11; identical to SEQ ID NO: 6329
  strain 11368 / EHEC

SEQ ID NO: 21226 - protein, 228 aa, Escherichia coli O26:H11; identical to SEQ ID NO: 6185
  strain 11368 / EHEC

SEQ ID NO: 21227 - protein, 843 aa, Escherichia coli O26:H11; identical to SEQ ID NO: 7909
  strain 11368 / EHEC

SEQ ID NO: 21228 - protein, 614 aa, Escherichia coli O26:H11; identical to SEQ ID NO: 6303
  strain 11368 / EHEC

SEQ ID NO: 21229 - protein, 446 aa, Escherichia coli O26:H11; identical to SEQ ID NO: 6459
  strain 11368 / EHEC

SEQ ID NO: 21230 - protein, 237 aa, Escherichia coli O26:H11; identical to SEQ ID NO: 9002
  strain 11368 / EHEC

SEQ ID NO: 21231 - protein, 478 aa, Escherichia coli O26:H11; identical to SEQ ID NO: 8858
  strain 11368 / EHEC

SEQ ID NO: 21232 - protein, 407 aa, Escherichia coli O26:H11; identical to SEQ ID NO: 9304
  strain 11368 / EHEC

SEQ ID NO: 21233 - protein, 696 aa, Escherichia coli O26:H11; identical to SEQ ID NO: 6320
  strain 11368 / EHEC

SEQ ID NO: 21234 - protein, 731 aa, Escherichia coli O26:H11; identical to SEQ ID NO: 8961
  strain 11368 / EHEC

SEQ ID NO: 21235 - protein, 511 aa, Escherichia coli O26:H11; identical to SEQ ID NO: 5749
  strain 11368 / EHEC

SEQ ID NO: 21236 - protein, 191 aa, Escherichia coli O26:H11; identical to SEQ ID NO: 5748
  strain 11368 / EHEC

SEQ ID NO: 21237 - protein, 512 aa, Escherichia coli O26:H11; identical to SEQ ID NO: 6251
  strain 11368 / EHEC

SEQ ID NO: 21238 - protein, 774 aa, Escherichia coli O26:H11; identical to SEQ ID NO: 8932
  strain 11368 / EHEC

SEQ ID NO: 21239 - protein, 232 aa, Escherichia coli O26:H11; identical to SEQ ID NO: 5747
  strain 11368 / EHEC

SEQ ID NO: 21240 - protein, 365 aa, Escherichia coli O26:H11; identical to SEQ ID NO: 6335
  strain 11368 / EHEC

SEQ ID NO: 21241 - protein, 729 aa, Escherichia coli O26:H11; identical to SEQ ID NO: 8894
  strain 11368 / EHEC

SEQ ID NO: 21242 - protein, 213 aa, Escherichia coli O26:H11; identical to SEQ ID NO: 5744
  strain 11368 / EHEC

SEQ ID NO: 21243 - protein, 89 aa, Escherichia coli O26:H11; identical to SEQ ID NO: 6232
  strain 11368 / EHEC

SEQ ID NO: 21244 - protein, 241 aa, Escherichia coli O26:H11; identical to SEQ ID NO: 6143
  strain 11368 / EHEC

SEQ ID NO: 21245 - protein, 878 aa, Escherichia coli O26:H11; identical to SEQ ID NO: 8797
  strain 11368 / EHEC

SEQ ID NO: 21246 - protein, 203 aa, Escherichia coli O26:H11; identical to SEQ ID NO: 6347
  strain 11368 / EHEC

SEQ ID NO: 21247 - protein, 565 aa, Escherichia coli O26:H11; identical to SEQ ID NO: 6492
  strain 11368 / EHEC

SEQ ID NO: 21248 - protein, 207 aa, Escherichia coli O26:H11; identical to SEQ ID NO: 5743
  strain 11368 / EHEC

SEQ ID NO: 21249 - protein, 551 aa, Escherichia coli O26:H11; identical to SEQ ID NO: 5742
  strain 11368 / EHEC

SEQ ID NO: 21250 - protein, 700 aa, Escherichia coli O26:H11; identical to SEQ ID NO: 8827
  strain 11368 / EHEC

SEQ ID NO: 21251 - protein, 883 aa, Escherichia coli O26:H11
  strain 11368 / EHEC
MTAFRAAFKAYRMHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKIALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVITVIPTHGAIARATFNAQIGGKVLMTLKYGNKSVPFGAIATHGENKNGSIVAENGQVYLTGLPQSGKLQVSWGKDKNSNCIVEYKLPEVSPGTLLNQQTAICR

SEQ ID NO: 21252 - protein, 236 aa, Escherichia coli O26:H11; identical to SEQ ID NO: 6472
  strain 11368 / EHEC

SEQ ID NO: 21253 - protein, 102 aa, Escherichia coli O26:H11; identical to SEQ ID NO: 6285
  strain 11368 / EHEC

SEQ ID NO: 21254 - protein, 118 aa, Escherichia coli O26:H11 [sequence omitted]

SEQ ID NO: 21255 - protein, 334 aa, Escherichia coli O26:H11; identical to SEQ ID NO: 6297
  strain 11368 / EHEC

SEQ ID NO: 21256 - protein, 673 aa, Escherichia coli O26:H11; identical to SEQ ID NO: 8833
  strain 11368 / EHEC

SEQ ID NO: 21257 - protein, 826 aa, Escherichia coli O26:H11; identical to SEQ ID NO: 8836
  strain 11368 / EHEC

SEQ ID NO: 21258 - protein, 224 aa, Escherichia coli O26:H11; identical to SEQ ID NO: 6435
  strain 11368 / EHEC

SEQ ID NO: 21259 - protein, 663 aa, Escherichia coli O26:H11; identical to SEQ ID NO: 6307
  strain 11368 / EHEC

SEQ ID NO: 21260 - protein, 828 aa, Escherichia coli O26:H11; identical to SEQ ID NO: 7891
  strain 11368 / EHEC

SEQ ID NO: 21261 - protein, 162 aa, Escherichia coli O26:H11; identical to SEQ ID NO: 5896
  strain 11368 / EHEC

SEQ ID NO: 21262 - protein, 363 aa, Escherichia coli O26:H11; identical to SEQ ID NO: 7893
  strain 11368 / EHEC

SEQ ID NO: 21263 - protein, 200 aa, Escherichia coli O26:H11; identical to SEQ ID NO: 6311
  strain 11368 / EHEC

SEQ ID NO: 21264 - protein, 274 aa, Escherichia coli O26:H11; identical to SEQ ID NO: 7895
  strain 11368 / EHEC

SEQ ID NO: 21265 - protein, 250 aa, Escherichia coli O26:H11; identical to SEQ ID NO: 8842
  strain 11368 / EHEC

SEQ ID NO: 21266 - protein, 881 aa, Escherichia coli O26:H11; identical to SEQ ID NO: 8916
  strain 11368 / EHEC

SEQ ID NO: 21267 - protein, 472 aa, Escherichia coli O26:H11; identical to SEQ ID NO: 5729
  strain 11368 / EHEC

SEQ ID NO: 21268 - protein, 998 aa, Escherichia coli O26:H11; identical to SEQ ID NO: 5650
  strain 11368 / EHEC

SEQ ID NO: 21269 - protein, 121 aa, Escherichia coli O26:H11
  strain 11368 / EHEC
MDAVLSVQGASAPVKKKSFFSKFTRLNMLRLARAVIPAAVLMMFFPQLAMAASSSGQDLMASGNNTVKATFGKDSSVVKWVVLAEVLVGAVMYMMTKNVKFLAGFAIISVFIAVGMAVVGL

SEQ ID NO: 21270 - protein, 866 aa, Escherichia coli O44:H18; identical to SEQ ID NO: 14734
  strain 042 / EAEC

SEQ ID NO: 21271 - protein, 243 aa, Escherichia coli O44:H18
  strain 042 / EAEC
MLNKKNIVALCVASSMAFSMPVMADIVISGTRVIYKSDQKSVSVRLENKGNSHLLVQSWLDTGDDNAEPGSINVPFTATPPVSRIDAKRGQTIKLMYTGSTVLPSDKESVFWFNVLEVPPKPDASKVENQSLLQLAFRTRIKLFYRPAGLNGNPSEAPLALKWKWAEGKSGLSVYNPTPYYVSFNSAELIAGGKSNPLNVKMVAPKSEEIFTISGSGGKATSGKVHFSAINDFGGAIEGDVNL

SEQ ID NO: 21272 - protein, 749 aa, Escherichia coli O44:H18
  strain 042 / EAEC
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVAVGTRGASNTYDYLIIRGFAADGQSQNNYLNGLKMQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGAEEQRYAIAPAFTWRPDDKTNFTFLSYFQNEPETGYYGWLPKEGTVEPLPNGKRLPTDFNEGAKNNTYSRNEKMIGYSFDHEFNDTFTVRQNLRFAQNKVSQKSVYGYGMCSDPLYSSNPSSSPCANVPQSQWGHTLTRQYVIDNEKLENFSVDTQLQSKFATGSVDHTLLTGVDFMRMRNDIDSWFGYAGSVAPSDIYNLDRSDFDFGAHPNPSGPYRVLLKQKQTGLYVQDQAQWDKVLVTLGGRYDWADQSSFNRDYGNKSDRDDKQFTWRGGVNYLFDNGVTPYFSYSESFEPASQTDANGDLFAPSKGKQYEVGVKYVPEDRPIVVTGALYQLTKTNNLMADPNGSLFSVEGGEIRARGVELEAKAALSASVNLVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 21273 - protein, 266 aa, Escherichia coli O44:H18; identical to SEQ ID NO: 5772
  strain 042 / EAEC

SEQ ID NO: 21274 - protein, 161 aa, Escherichia coli O44:H18; identical to SEQ ID NO: 5769
  strain 042 / EAEC

SEQ ID NO: 21275 - protein, 551 aa, Escherichia coli O44:H18
  strain 042 / EAEC
MDRRRFIKGSMAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIEGYRIQFDWYPTSDSTDPVDMRMYLRCQGDAISETWLYQYFPPAPDKRQYVDDRVMS

SEQ ID NO: 21276 - protein, 700 aa, Escherichia coli O44:H18; identical to SEQ ID NO: 8120
  strain 042 / EAEC

SEQ ID NO: 21277 - protein, 366 aa, Escherichia coli O44:H18; identical to SEQ ID NO: 7432
  strain 042 / EAEC

SEQ ID NO: 21278 - protein, 628 aa, Escherichia coli O44:H18
  strain 042 / EAEC
MKPAASFFYCGCFTMIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVTVGHGNIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 21279 - protein, 221 aa, Escherichia coli O44:H18; identical to SEQ ID NO: 6115
  strain 042 / EAEC

SEQ ID NO: 21280 - protein, 371 aa, Escherichia coli O44:H18
  strain 042 / EAEC
MPESAMQNWIKAAAIAVSLALPGVALAQSLESLVNVQGVRENQLVGYSLVVGLDGTGDKNQVKFTNQTITNMLRQFGVQLPNKIDPKVKNVAAVAVSATLPPMYSRGQTIDVTVSSIGDAKSIRGGTLLLTQLHGADGEVYALAQGSVVVGGMNATGASGSSVTVNTPTAGLIPNGATVEREIPSDFQMGDTITLNLKRPSFKDANNIAAAINASFGGIATAQSSTNVTVRAPTSPGARVAFMSQLDDVQVQVEKIRARVVFNSRTGTVVMGDGVALHAAAVSHGSLTVSINETSNVSQPNAFAGGRTAVTPQSNIAVNHARPGVVSLPESSSLKTLVNALNSLGATPDDIMSILQALHEAGALDADLEVI

SEQ ID NO: 21281 - protein, 883 aa, Escherichia coli O44:H18
  strain 042 / EAEC
MTAFRAAFKAYRMHQVLLLPRFARLTIALGLATAVFPVDAEYYFNPRFLSNDLAESVDLSAFTKGREAPPGTYRVDIYLNDEFMTSRDITFIADDNNADLIPCLSTELLVSLGIKKSALLDNKEHSAEKHVPDNSTCTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAENYQAFNLGIGKDLGLFGAFSFDITQANTTLADDTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 21282 - protein, 239 aa, Escherichia coli O44:H18; identical to SEQ ID NO: 10812
  strain 042 / EAEC

SEQ ID NO: 21283 - protein, 432 aa, Escherichia coli O44:H18; identical to SEQ ID NO: 5727
  strain 042 / EAEC

SEQ ID NO: 21284 - protein, 446 aa, Escherichia coli O44:H18; identical to SEQ ID NO: 7485
  strain 042 / EAEC

SEQ ID NO: 21285 - protein, 237 aa, Escherichia coli O44:H18; identical to SEQ ID NO: 6384
  strain 042 / EAEC

SEQ ID NO: 21286 - protein, 351 aa, Escherichia coli O44:H18; identical to SEQ ID NO: 5767
  strain 042 / EAEC

SEQ ID NO: 21287 - protein, 102 aa, Escherichia coli O44:H18; identical to SEQ ID NO: 14041
  strain 042 / EAEC

SEQ ID NO: 21288 - protein, 567 aa, Escherichia coli O44:H18; identical to SEQ ID NO: 6075
  strain 042 / EAEC

SEQ ID NO: 21289 - protein, 478 aa, Escherichia coli O44:H18
  strain 042 / EAEC
MTRIKINARRIFSLLIPFFFFTSVHAEQTATPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 21290 - protein, 360 aa, Escherichia coli O44:H18; identical to SEQ ID NO: 6702
  strain 042 / EAEC

SEQ ID NO: 21291 - protein, 686 aa, Escherichia coli O44:H18; identical to SEQ ID NO: 6339
  strain 042 / EAEC

SEQ ID NO: 21292 - protein, 713 aa, Escherichia coli O44:H18; identical to SEQ ID NO: 11726
  strain 042 / EAEC

SEQ ID NO: 21293 - protein, 222 aa, Escherichia coli O44:H18
  strain 042 / EAEC
MSKLGISSLFKTILLTAALAVSFTASAFTEGTDYMVLEKPIPNADKTLIKVFSYACPFCYKYDKAVTGPVSEKVKDVVAFTPFHLETKGEYGKQASEVFAVLINKDKAAGISLFDANSQFKKAKFAYYAAYHDKKERWSDGKDPAAFIKTGLDAAGMSQADFEAALKEPAVQETLEKWKASYEVAKIQGVPAYVVNGKYLIYTKSIKSIDSMADLIRELASK

SEQ ID NO: 21294 - protein, 840 aa, Escherichia coli O44:H18
  strain 042 / EAEC
MNNKNTFTGDKLSHAIKIALSGVVCSLLFVLPVHAVEFNVDMIDVEDRENIDISRFEKKGYITPGKYLVRVQINKNMLPQTLILEWVKADNESGSLLCLTKENLTSFGLNTEFIESLQTIAGSECLNLSQRQELTTRLDKATMILSLSVPQAWLKYQATNWTPPEFWDAGIAGFILDYNMYASQYAPHHGDSTQNVSSYGTLGFNLGAWRLRSDYQYNQNFADGRSVNHDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSDNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGVEINSNRTVTNGLGIAVIPSLSNYTTSMLRVNNNDLPEGVDVENSVIRTTLTQGAIGYAKLNATTGYQIVGVIRQENGRFPPLGVNVTDQATGKDVGLVAEDGFVYLSGIQENSILHLTWGDNTCEVTPPNQSNISESAIILPCKTVK

SEQ ID NO: 21295 - protein, 249 aa, Escherichia coli O44:H18; identical to SEQ ID NO: 5852
  strain 042 / EAEC

SEQ ID NO: 21296 - protein, 230 aa, Escherichia coli O44:H18; identical to SEQ ID NO: 6360
  strain 042 / EAEC

SEQ ID NO: 21297 - protein, 869 aa, Escherichia coli O44:H18
  strain 042 / EAEC
MKIPTTTDIPQRYTWCLAGICYSSLAILPSFLSYAESYFNPAFLLENGTSVADLSRFERGNHQPAGVYRVDLWRNDEFIGSQDIVFESTTVNTGDKSGGLMPCFNQALLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQRLQQAVTVISAVCTHPGS

SEQ ID NO: 21298 - protein, 746 aa, Escherichia coli O44:H18; identical to SEQ ID NO: 8052
  strain 042 / EAEC

SEQ ID NO: 21299 - protein, 118 aa, Escherichia coli O44:H18 [sequence omitted]

SEQ ID NO: 21300 - protein, 678 aa, Escherichia coli O44:H18
  strain 042 / EAEC
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRIWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPAATTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSHSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 21301 - protein, 774 aa, Escherichia coli O44:H18; identical to SEQ ID NO: 13044
  strain 042 / EAEC

SEQ ID NO: 21302 - protein, 368 aa, Escherichia coli O44:H18; identical to SEQ ID NO: 7693
  strain 042 / EAEC

SEQ ID NO: 21303 - protein, 193 aa, Escherichia coli O44:H18; identical to SEQ ID NO: 6300
  strain 042 / EAEC

SEQ ID NO: 21304 - protein, 334 aa, Escherichia coli O44:H18
  strain 042 / EAEC
MKKNQFLKESDVTAESVFFMKRRQVLKALGISAAALSLPHAAHADLLSWFKGNDRPPALAGKALEFSKPAAWQNNLPLTPADKVSGYNNFYEFGLDKADPAANAGSLKTDPWTLKISGEVAKPLTLDHDDLTRRFPLEERIYRMRCVEAWSMVVPWIGSPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILDVQRQPTLLFNGYADQVASLYRGLDLRENF

SEQ ID NO: 21305 - protein, 245 aa, Escherichia coli O44:H18
  strain 042 / EAEC
MKMTFMKGLPLLLLVASLCSHAALQPDRTRIVFNANDKATSLRVDNRSDKLPYLAYSWLENEKGEKSDDLLVALPPIQRLEPKATTQVRIVKQVSTTKLPGDRETLFFYNMREIPPAPEKNSGHAVLQVAIQSRIKVFWRPSALRKKAGEKVELQLQVSQQGNQLNLKNPTGYYLTIAYLGRNEQGILPGFKTVMVAPFSTVITNTGSYSGRQFYLGYMDDYGALRMTTLNCSGQCRLQAVEAKK

SEQ ID NO: 21306 - protein, 819 aa, Escherichia coli O44:H18
  strain 042 / EAEC
MDTVNIYRLSFISCLVMAMPSALAVEFNLNVLDKSMRDRIDISLLKEKGVIAPGEYFVSVAVNNNQISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASSYRPQDGSSSTNLNAYGTAGINAGAWRLRSDYQLNKTDSEDNHDQSGEISRTYLFRPLPQLGSKLTLGETDFSSNIFDSFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLTAGQPRPSMSHQTENETFFSNEVSWGMLSNTSLYGGLLISGDNYHSAAMGIGQNMLWLGALSFDVTWASSQFDTQQDERGLSYRFNYSKQVDATNSTISLAAYRFSDRHFHSYANYLDHKYNDNDAQDEKQTISLSVGQPITPLNLNLYANLLHQTWWNADASTTANITAGFNVDIGNWRDISISTSFNTTHYEDKDRDNQIYLSISLPFGNGGRVGYDMQNSGHSTTHRMSWNDTLDERNSWGMSTGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVADNVIKETWIEGAIGYKSLASRSGKDVNVIIRNASGQFPPLGADIRQEDSGISVGMVGEEGHAWLSGVAENQQFTVIWGDSQRCSIHLPEHMEDTANRLILPCH

SEQ ID NO: 21307 - protein, 430 aa, Escherichia coli O44:H18; identical to SEQ ID NO: 5758
  strain 042 / EAEC

SEQ ID NO: 21308 - protein, 673 aa, Escherichia coli O44:H18
  strain 042 / EAEC
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMKTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 21309 - protein, 332 aa, Escherichia coli O44:H18; identical to SEQ ID NO: 5757
  strain 042 / EAEC

SEQ ID NO: 21310 - protein, 760 aa, Escherichia coli O44:H18
  strain 042 / EAEC
MENNRNFPARQFHSLTFFAGLCISITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGMAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 21311 - protein, 386 aa, Escherichia coli O44:H18
  strain 042 / EAEC
MVDDVPVAQVLQALAEQEKLNLVVSPDVSGTVSLHLTDVPWKQALQTVVKSAGLITRQEGNILSVHSVAWQNDNIARQEAEQARAQANLPLENRNITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 21312 - protein, 203 aa, Escherichia coli O44:H18
  strain 042 / EAEC
MKKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGTVDAAKFTFTPPQGVTVDDQRK

SEQ ID NO: 21313 - protein, 831 aa, Escherichia coli O44:H18
  strain 042 / EAEC
MQELSMLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYSWDIGVFRLDFSVPQAWVEELESGYVPPENWERGINAFYTSYYVSQYYSDYKASGNNKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTSWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVTTPRRQIYMSNSTTFDDQGFASNNTGLSGTVGNRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRTDGQPLTFGYEVNDIHGHNIGVVGQGSQLFIRTNEVPPSVNVAIDKQQGLSCTITFGKEIDESRNYICQ

SEQ ID NO: 21314 - protein, 224 aa, Escherichia coli O44:H18
  strain 042 / EAEC
MKGLLALLISSMVLPAHAGIVIYGTRIIYPAEHKEVMVQLMNQGNRSSLLQAWIDDGDTSLPPEKIQVPFMLTPPVAKIGENSGQQVKIKIMPNKLPTNKESIFYLNVLDIPPNSPEQEGKNALKFAMQNRIKLFYRPAGIAPVNKATFKKLLINRSGNGLVIKNDSANWVTISDVKANNVKVNYETIMIAPLESQSVNVKSNNANNWYLTIIDDHGNYISDKI

SEQ ID NO: 21315 - protein, 690 aa, Escherichia coli O44:H18
  strain 042 / EAEC
MLPYARGRKEDVSDTHFIFVVTSWRYGMFRLNPFVRVGLCLSAISCAWPVLAVDDDSETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWKVTKDVKLRAGVLNLGDKDLSRDDYSYNEDGRRYFMAVDYRF

SEQ ID NO: 21316 - protein, 250 aa, Escherichia coli O44:H18; identical to SEQ ID NO: 17304
  strain 042 / EAEC

SEQ ID NO: 21317 - protein, 357 aa, Escherichia coli O44:H18; identical to SEQ ID NO: 5807
  strain 042 / EAEC

SEQ ID NO: 21318 - protein, 828 aa, Escherichia coli O44:H18; identical to SEQ ID NO: 6558
  strain 042 / EAEC

SEQ ID NO: 21319 - protein, 162 aa, Escherichia coli O44:H18; identical to SEQ ID NO: 8101
  strain 042 / EAEC

SEQ ID NO: 21320 - protein, 368 aa, Escherichia coli O44:H18; identical to SEQ ID NO: 5787
  strain 042 / EAEC

SEQ ID NO: 21321 - protein, 660 aa, Escherichia coli O44:H18
  strain 042 / EAEC
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGAKLENRSTLFADSFASHLLTYGGEYYRQEQHPGGATTGFPQAKIDFSSGWLQDEITLRDLPITLLGGTRYDSYRGSSDGYKDVDADKWSSRAGMTINPANWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 21322 - protein, 517 aa, Escherichia coli O44:H18; identical to SEQ ID NO: 6817
  strain 042 / EAEC

SEQ ID NO: 21323 - protein, 191 aa, Escherichia coli O44:H18; identical to SEQ ID NO: 8071
  strain 042 / EAEC

SEQ ID NO: 21324 - protein, 232 aa, Escherichia coli O44:H18
  strain 042 / EAEC
MQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLANGNLHVVGEKQIAINQGTEFIRFSGVVNPRTISGSNTVPSTQVADARIEYVGNGYINEAQNMGWLQRFFLNLSPM

SEQ ID NO: 21325 - protein, 366 aa, Escherichia coli O44:H18
  strain 042 / EAEC
MVIKFLSALILLLVTTVAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINSRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 21326 - protein, 200 aa, Escherichia coli O44:H18; identical to SEQ ID NO: 7474
  strain 042 / EAEC

SEQ ID NO: 21327 - protein, 686 aa, Escherichia coli O44:H18
  strain 042 / EAEC
MIVEGSATTPVDDENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPNEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 21328 - protein, 213 aa, Escherichia coli O44:H18; identical to SEQ ID NO: 5744
  strain 042 / EAEC

SEQ ID NO: 21329 - protein, 203 aa, Escherichia coli O44:H18; identical to SEQ ID NO: 6347
  strain 042 / EAEC

SEQ ID NO: 21330 - protein, 656 aa, Escherichia coli O44:H18
  strain 042 / EAEC
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEANLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFIEEGRNFWAGIEYTF

SEQ ID NO: 21331 - protein, 565 aa, Escherichia coli O44:H18
  strain 042 / EAEC
MKSPAASRPLKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPKGQSLREHIDGLWPVLTRSTESTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKASGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQNEVAMDISWHFLTNVQHTYDREKKLVEKYDVSTTGTGGGGGEYPLQDGFGWTNGVTLKMLDLICPKEQPCDNVPATRPLSESTTQPVKQKEAEPTP

SEQ ID NO: 21332 - protein, 274 aa, Escherichia coli O44:H18; identical to SEQ ID NO: 8098
  strain 042 / EAEC

SEQ ID NO: 21333 - protein, 249 aa, Escherichia coli O44:H18
  strain 042 / EAEC
MTKYLSAKTLTTVLSLLAATVSFSTQASVTPDRTRLIFNESDKSISVTLRNNDPKLPYLAQSWIEDEKGVKISSPLAVLPPVQRIDAMMNGQVKIQGLPDIHKLPADRESMFYFNVREIPPKSNKSNTLQIALQTRIKLFWRPKALEKNTTQNPWQHKVTLTRNGQEFTVNNPTPYYVIFSNASAQKNGNPAAGFSPIVMSPKTSAPLNVKMGSVPVLTYVNDYGARMPLFFTCNGNSCQVDEEQSRKG

SEQ ID NO: 21334 - protein, 879 aa, Escherichia coli O44:H18
  strain 042 / EAEC
MPEHSFLRLRGLSWWIALAISGSPFNALADDIIQFDGRFLDLKGNTKIDLGRFSQKGYVEPGKYNLRVHVNNQPLPDDYDIYWYATENDPNKSYACLSPELVAQFGLKEDIAKNLQWIRDGQCLNTALLAGTEISGDLGQSALLVSVPQAYLEYTDSEWDPPSRWDDGIPGLIADYSINAQTRHENGGDDTNDISGNGTVGVNVGPWRLRADWQSDYQHTRSNDDGDTDDSGTQKNWEWSRYYAWRALPSLKAKLSLGEDYLNSDIFDGFSYIGGSISTDDQMLPPNLRGYAPDISGVAHTTAKVTVTQMGRVIYETQVPAGPFRIQDIGDSVSGTLHVRIEEQNGQVQEYDVSTASMPFLTRPGQVRYKVTMGRPQNWDHQVAGSFFSGGEASWGIANGWSLYGGALADENYQSAALGLGRDLALLGALAFDVTHSRVQLDDNSVYGNKTLDGNSYRVSYAKDFDELNSRVTFAGYRFSEKNYMTMSEYLDANDDDRARTGNDKEMYTVTYNQNFTDARVSVYLNYSHHTYWDRQDQTNYNMMLSHYFNLGSLRNLSVSLTGYRYEYDKSADKGVYLSLSLPWGDNSTISYNGNYGSGADSNQVSLYHRIDDASHYTVSAGTSENHSSVDGYYSHDGTLAKVDLSANYHEGQYTSAGISLQGGATLTAHGGALHRTQNMGGTRLLIDADGVANVAVEGNGSAVYTNMFGKAVVADVNDYYRNQAYIDLNKLPENAEATKSVVQATLTEGAIGYRKFAVISGEKAMAVLRLQDGSHPPFGAEVKNDNQQQVGLVDDEGNVYLAGVKPGEHMTVFWEGESHCDISLPDPLPNDLFNGLLLPCQQKGGSSPVIPHDIQPVIQEQTQQVTPMEPPMSVSSNQ

SEQ ID NO: 21335 - protein, 207 aa, Escherichia coli O44:H18; identical to SEQ ID NO: 5743
  strain 042 / EAEC

SEQ ID NO: 21336 - protein, 243 aa, Escherichia coli O44:H18; identical to SEQ ID NO: 14800
  strain 042 / EAEC

SEQ ID NO: 21337 - protein, 816 aa, Escherichia coli O44:H18
  strain 042 / EAEC
MLRTTRWVAAIIFLYSFPGYAEETFDTHFMIGGMKGEKVSEYHFDNKQPLPGNYELDFYVNNQWRGKQDITIPESPVKPCLPKVLLTKLGVKTGNLNTEDNCILLDKAVHGGQYQWDISEHRLNLTVPQAYINELERGYVPPESWDRGIDAFYTSYNLSQYRSYDSNNNSNTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYTIYQKEVPPGPFTIADLQLSGSGSDLDVSIKEADGSVRSFLVPYSSVPNMLQPGVSNFDFIAGRSQIYGVKNQEDFLEANYIYGLNNLLTLYGGTILSDNYNAITLGNGWNTPLGAISFDATRSSSKLNNDTRHEGTSYQVAYNKYLLQTATHFSVAAWRYASQDYRTFSDHLYENDKINHQSDYDDFYDIGRKNSLSANIMQPLSNNLGNVSLSALWRNYWGRSGNAKDYQFSYSNNWQHISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPIATIDGSYSHSKNAWQSGGSISSGLVVWPGGINITNQLSDTFAILDAPGLEGAHINGQKYNRTNSKGQVVYDLMIPHRENHLVLDIANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 21338 - protein, 187 aa, Escherichia coli O44:H18
  strain 042 / EAEC
MNQSKNASLIQAWIDDGNTTIAPEKIQVPFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSNNDITLKNNHASEYELTVVDDYGNNIHSKIAAR

SEQ ID NO: 21339 - protein, 518 aa, Escherichia coli O44:H18; identical to SEQ ID NO: 6358
  strain 042 / EAEC

SEQ ID NO: 21340 - protein, 784 aa, Escherichia coli O44:H18; identical to SEQ ID NO: 14072
  strain 042 / EAEC

SEQ ID NO: 21341 - protein, 170 aa, Escherichia coli O44:H18; identical to SEQ ID NO: 5855
  strain 042 / EAEC

SEQ ID NO: 21342 - protein, 208 aa, Escherichia coli O44:H18; identical to SEQ ID NO: 5717
  strain 042 / EAEC

SEQ ID NO: 21343 - protein, 249 aa, Escherichia coli O44:H18
  strain 042 / EAEC
MKIRRIRLVLILALVFFMNAQASENTRVFSLHLGATRVVYNQQSSGEALAVINDHNYPMLVQSEVLTEDKKESAPFVITPPLFRLDALQSSRLRVVRIGGTFPADRETLQWICVKGIPPKANDRWAENDSKNVLDNKVALNIHLSVTSCIKLFFRPLVVKGHPEDVAGEVRWQKIGDKLKGINPTPFYINLSELKFGGEEITERHYIAPFSSYEYLIPKTMNRNNIVQWKVVTDYGGISKQFEAKINKL

SEQ ID NO: 21344 - protein, 840 aa, Escherichia coli O44:H18
  strain 042 / EAEC
MTCTLLHVEDVIARTYSFNSSLLSGGGKGVDLTLFEEGGQLPGIYQTDIILNGSRVDSLEMPFHTEKDENGRPYLKTCLTQEMLARYGVKTEEYPALFRSLGGGSDTSGERGVCADLSAIPQATENYQFAAQQLVLGIPQVALRPLLRGIAPEVLWDDGIPAFLLNWQANAGRSEYRGYIKDVEDYFWSSLEPGINIGSWRIRNLTTWNKSSGQSGKWESLYIRAERGLNSLKSRLTLGENYTPSDIFDSVPFRGGMLSSDESMVPYNQREFAPVVRGIARTQARIEVRQNGYLIQSQTVAPGAFALTDLPVTGSGSDLQVTVRESDGTVQVFTVPFTTPAIALREGYLKYNVMAGQYRSSDDAVEDSTLGQVMGMYGLPWGLTVFGGLQGAEHYQSAALGLGWSLGKLGAVSLDTIHSRGQQKGYNYETGNTWRIRYNKSFELTGTSFTAASYQYSSSGYHTLSDVLETYRDDGRFAYRSTDSRTSRTTVNLSQSLGRWGYLGLNGSRDEYRDRPHQDYIGASYGASWNRMSLSVNWSRNHSTRGYYGSKSRTEDSISIWMSIPLESWLGRSDNNISATAQMQRSTEQNTRYELGLNGRAFDRRLFWEVHEQMVSGSEYNTGTSRLNLRWSGTYGELAGMYSYSSNMRQINAGMSGSMVAHGEGVTFGQRAGDTVTLIAAPGVSGASVGDWPGVRTDFRGYALAGYASPYQENVITLDPTTFPEDAEVPQTDSRVVPTKGAVVRAGFRTRVGGRALVSLTRQDGSSLPFGAIVTLEGKPGETSGSAGVVDDKGRVYLSGLSETGKLKAQWGENSLCHADYRLPEEKGPAGIFLTRTVCM

SEQ ID NO: 21345 - protein, 121 aa, Escherichia coli O44:H18
  strain 042 / EAEC
MNTVLSVQGASAPVEKKSFFSKFTRLNMLRLVRAVIPAAVLMMFFPQLAMAAQGAGQDLMQSGNSTVKATFGKDSSVVKWVVLAEVLVGAVMYMMTKNVKFLAGFAIISVFIAVGMAVVGL

SEQ ID NO: 21346 - protein, 1295 aa, Escherichia coli O44:H18
  strain 042 / EAEC
MNKIYSIKYSAATGGLIAVSELAKKVICKTNRKISAALLSLAVISYTNIIYAANMDISKAWARDYLDLAQNKGVFQPGSTHVKIKLKDGTDFSFPALPVPDFSSATANGAATSIGGAYAVTVAHNAKNKSSANYQTYGSTQYTQINRMTTGNDFSIQRLNKYVVETRGADTSFNYNENNQNIIDRYGVDVGNGKKEIIGFRVGSGNTTFSGIKTSQTYQADLLSASLFHITNLRANTVGGNKVEYENDSYFTNLTTNGDSGSGVYVFDNKEDKWVLLGTTHGIIGNGKTQKTYVTPFDSKTTNELKQLFIQNVNIDNNTATIGGGKITIGNTTQDIEKNKNNQNKDLVFSGGGKISLKENLDLGYGGFIFDENKKYTVSAEGNNNVTFKGAGIDIGKGSTVDWNIKYASNDALHKIGEGSLNVIQAQNTNLKTGNGTVILGAQKTFNNIYVAGGPGTVQLNAENALGEGDYAGIFFTENGGKLDLNGHNQTFKKIAATDSGTTITNSNTTKESVLSVNNQNNYIYHGNVDGNVRLEHHLDTKQDNARLILDGDIQANSISIKNAPLVMQGHATDHAIFRTTKTNNCPEFLCGVDWVTRIKNAENSVNQKNKTTYKSNNQVSDLSQPDWETRKFRFDNLNIEDSSLSIARNADVEGNIQAKNSVINIGDKTAYIDLYSGKNITGAGFTFRQDIKSGDSIGESKFTGGIMATDGSISIGDKAIVTLNTVSSLDRTALTIHKGANVTASSSLFTTSNIKSGGDLTLTGATESTGEITPSMFYAAGGYELTEDGANFTAKNQASVTGDIKSEKAAKLSFGSADKDNSATRYSQFALAMLDGFDTSYQGSIKAAQSSLAMNNALWKVTGNSELKKLNSTGSMVLFNGGKNIFNTLTVDELTTSNSAFVMRTNTQQADQLIVKNKLEGANNLLLVDFIEKKGNDKNGLNIDLVKAPENTSKDVFKTETQTIGFSDVTPEIKQQEKDGKSVWTLTGYKTVANADAAKKATSLMSGGYKAFLAEVNNLNKRMGDLRDINGEAGAWARIMSGTGSAGGGFSDNYTHVQVGADNKHELDGLDLFTGVTMTYTDSHAGSDAFSGETKSVGAGLYASAMFESGAYIDLIGKYVHHDNEYTATFAGLGTRDYSSHSWYAGAEVGYRYHVTDSAWIEPQAELVYGAVSGKQFSWKDQGMNLTMKDKDFNPLIGRTGVDVGKSFSGKDWKVTARAGLGYQFDLFANGETVLRDASGEKRIKGEKDGRMLMNVGLNAEIRDNVRFGLEFEKSAFGKYNVDNAINANFRYSF

SEQ ID NO: 21347 - protein, 1372 aa, Escherichia coli O44:H18
  strain 042 / EAEC
MNKVYSLKYCPVTGGLIAVSELARRVIKKTCRRLTHILLAGIPAICLCYSQISQAGIVRSDIAYQIYRDFAENKGLFVPGANDIPVYDKDGKLVGRLGKAPMADFSSVSSNGVATLVSPQYIVSVKHNGGYRSVSFGNGKNTYSLVDRNNHPSIDFHAPRLNKLVTEVIPSAVTSEGTKANAYKYTERYTAFYRVGSGTQYTKDKDGNLVKVAGGYAFKTGGTTGVPLISDATIVSNPGQTYNPVNGPLPDYGAPGDSGSPLFAYDKQQKKWVIVAVLRAYAGINGATNWWNVIPTDYLNQVMQDDFDAPVDFVSGLGPLNWTYDKTSGTGTLSQGSKNWTMHGQKDNDLNAGKNLVFSGQNGAIILKDSVTQGAGYLEFKDSYTVSAESGKTWTGAGIITDKGTNVTWKVNGVAGDNLHKLGEGTLTINGTGVNPGGLKTGDGIVVLNQQADTAGNIQAFSSVNLASGRPTVVLGDARQVNPDNISWGYRGGKLDLNGNAVTFTRLQAADYGAVITNNAQQKSQLLLDLKAQDTNVSEPTIGNISPFGGTGTPGNLYSMILNSQTRFYILKSASYGNTLWGNSLNDPAQWEFVGMDKNKAVQTVKDRILAGRAKQPVIFHGQLTGNMDVAIPQVPGGRKVIFDGSVNLPEGTLSQDSGTLIFQGHPVIHASISGSAPVSLNQKDWENRQFTMKTLSLKDADFHLSRNASLNSDIKSDNSHITLGSDRAFVDKNDGTGNYVIPEEGTSVPDTVNDRSQYEGNITLNHNSALDIGSRFTGGIDAYDSAVSITSPDVLLTAPGAFAGSSLTVHDGGHLTALNGLFSDGHIQAGKNGKITLSGTPVKDTANQYAPAVYLTDGYDLTGDNAALEITRGAHASGDIHASAASTVTIGSDTPAELASAETAASAFAGSLLEGYNAAFNGAITGGRADVSMHNALWTLGGDSAIHSLTVRNSRISSEGDRTFRTLTVNKLDATGSDFVLRTDLKNADKINVTEKATGSDNSLNVSFMNNPAQGQALNIPLVTAPAGTSAEMFKAGTRVTGFSRVTPTLHVDTSGGNTKWILDGFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFASLGTKHYNTHSWYAGAETGYRYHLTEDTFIEPQAELVYGAVSGKTFRWKDGDMDLSMKNRDFSPLVGRTGVELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 21348 - protein, 733 aa, Escherichia coli O45:K1; identical to SEQ ID NO: 5674
  strain S88 / ExPEC

SEQ ID NO: 21349 - protein, 121 aa, Escherichia coli O45:K1; identical to SEQ ID NO: 6175
  strain S88 / ExPEC

SEQ ID NO: 21350 - protein, 720 aa, Escherichia coli O45:K1
  strain S88 / ExPEC
MRINKILWSLTVLLVGLNSQISVAKSSDDDNDETLVVEATAEQVLKQQPGVSVITSEDIKKTPPVNDLSDIIRKMPGVNLTGNSASGTRGNNRQIDIRGMGPENTLILIDGVPVTSRNSVRYSWRGERDTRGDTNWVPPEQVERIEVIRGPAAARYGSGAAGGVVNIITKRPTNDWHGSLSLYTNQPESSDEGATRRANFSLSGPLAGNALTTRLYGNLNKTDADSWDINSPVGTKNAAGHEGVRNKDINGVVSWKLNPQQILDFEAGYSRQGNIYAGDTQNSSSSAVTESLAKSGKETNRLYRQNYGITHNGIWDWGQSRFGVYYEKTNNTRMNEGLSGGGEGRILAGEKFTTNRLSSWRTSGELNIPLNVMVDQTLTVGAEWNRDKLDDPSSTSLTVNDSDISGISGSAADRSSKNHSQISALYIEDNIEPVPGTNIIPGLRFDYLSDSGGNFSPSLNLSQELGDYFKVKAGVARTFKAPNLYQSSEGYLLYSKGNGCPGGCYLIGNKDLDPEISVNKEIGLEFTWEDYHASVTYFRNDYQNKIVAGDNVIGQTASGAYILKWQNGGKALVDGIEASMSFPLVKDRLNWNTNATWMITSEQKDTGNPLSVIPKYTINNSLNWTITQAFSASVNWTLYGRQKPRTHAETRSEDTGGLSGKELGAYSLVGTNFNYDINKNLRLNVGVSNILNKQIFRSSEGANTYNEPGRAYYAGVTASF

SEQ ID NO: 21351 - protein, 102 aa, Escherichia coli O45:K1; identical to SEQ ID NO: 14041
  strain S88 / ExPEC

SEQ ID NO: 21352 - protein, 713 aa, Escherichia coli O45:K1; identical to SEQ ID NO: 6056
  strain S88 / ExPEC

SEQ ID NO: 21353 - protein, 222 aa, Escherichia coli O45:K1; identical to SEQ ID NO: 7531
  strain S88 / ExPEC

SEQ ID NO: 21354 - protein, 840 aa, Escherichia coli O45:K1; identical to SEQ ID NO: 7530
  strain S88 / ExPEC

SEQ ID NO: 21355 - protein, 249 aa, Escherichia coli O45:K1; identical to SEQ ID NO: 7529
  strain S88 / ExPEC

SEQ ID NO: 21356 - protein, 784 aa, Escherichia coli O45:K1; identical to SEQ ID NO: 6829
  strain S88 / ExPEC

SEQ ID NO: 21357 - protein, 170 aa, Escherichia coli O45:K1; identical to SEQ ID NO: 5855
  strain S88 / ExPEC

SEQ ID NO: 21358 - protein, 678 aa, Escherichia coli O45:K1; identical to SEQ ID NO: 7525
  strain S88 / ExPEC

SEQ ID NO: 21359 - protein, 331 aa, Escherichia coli O45:K1; identical to SEQ ID NO: 17835
  strain S88 / ExPEC

SEQ ID NO: 21360 - protein, 862 aa, Escherichia coli O45:K1; identical to SEQ ID NO: 7497
  strain S88 / ExPEC

SEQ ID NO: 21361 - protein, 246 aa, Escherichia coli O45:K1; identical to SEQ ID NO: 5857
  strain S88 / ExPEC

SEQ ID NO: 21362 - protein, 747 aa, Escherichia coli O45:K1; identical to SEQ ID NO: 7499
  strain S88 / ExPEC

SEQ ID NO: 21363 - protein, 266 aa, Escherichia coli O45:K1; identical to SEQ ID NO: 7500
  strain S88 / ExPEC

SEQ ID NO: 21364 - protein, 810 aa, Escherichia coli O45:K1; identical to SEQ ID NO: 6345
  strain S88 / ExPEC

SEQ ID NO: 21365 - protein, 161 aa, Escherichia coli O45:K1; identical to SEQ ID NO: 5769
  strain S88 / ExPEC

SEQ ID NO: 21366 - protein, 122 aa, Escherichia coli O45:K1; identical to SEQ ID NO: 5737
  strain S88 / ExPEC

SEQ ID NO: 21367 - protein, 351 aa, Escherichia coli O45:K1; identical to SEQ ID NO: 7560
  strain S88 / ExPEC

SEQ ID NO: 21368 - protein, 360 aa, Escherichia coli O45:K1; identical to SEQ ID NO: 5891
  strain S88 / ExPEC

SEQ ID NO: 21369 - protein, 334 aa, Escherichia coli O45:K1; identical to SEQ ID NO: 7534
  strain S88 / ExPEC

SEQ ID NO: 21370 - protein, 673 aa, Escherichia coli O45:K1; identical to SEQ ID NO: 8416
  strain S88 / ExPEC

SEQ ID NO: 21371 - protein, 650 aa, Escherichia coli O45:K1
  strain S88 / ExPEC
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNSRKPSSTSAMDNVAITADEQTNSLVITADQSVQEKLATVIARLDIRRAQVLVEAIIVEVQDGNGLNLGVQWANKNVGAQQFTNTGLPVFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQLRIDGKSKALIGSEDLPVLDENTFNSHAPAPSSR

SEQ ID NO: 21372 - protein, 900 aa, Escherichia coli O45:K1; identical to SEQ ID NO: 7567
  strain S88 / ExPEC

SEQ ID NO: 21373 - protein, 412 aa, Escherichia coli O45:K1; identical to SEQ ID NO: 7596
  strain S88 / ExPEC

SEQ ID NO: 21374 - protein, 266 aa, Escherichia coli O45:K1; identical to SEQ ID NO: 7595
  strain S88 / ExPEC

SEQ ID NO: 21375 - protein, 259 aa, Escherichia coli O45:K1; identical to SEQ ID NO: 6832
  strain S88 / ExPEC

SEQ ID NO: 21376 - protein, 826 aa, Escherichia coli O45:K1; identical to SEQ ID NO: 7523
  strain S88 / ExPEC

SEQ ID NO: 21377 - protein, 224 aa, Escherichia coli O45:K1; identical to SEQ ID NO: 5893
  strain S88 / ExPEC

SEQ ID NO: 21378 - protein, 660 aa, Escherichia coli O45:K1; identical to SEQ ID NO: 6109
  strain S88 / ExPEC

SEQ ID NO: 21379 - protein, 746 aa, Escherichia coli O45:K1
  strain S88 / ExPEC
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGYETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 21380 - protein, 663 aa, Escherichia coli O45:K1; identical to SEQ ID NO: 5894
  strain S88 / ExPEC

SEQ ID NO: 21381 - protein, 828 aa, Escherichia coli O45:K1; identical to SEQ ID NO: 7510
  strain S88 / ExPEC

SEQ ID NO: 21382 - protein, 162 aa, Escherichia coli O45:K1; identical to SEQ ID NO: 8101
  strain S88 / ExPEC

SEQ ID NO: 21383 - protein, 363 aa, Escherichia coli O45:K1; identical to SEQ ID NO: 7508
  strain S88 / ExPEC

SEQ ID NO: 21384 - protein, 193 aa, Escherichia coli O45:K1; identical to SEQ ID NO: 6300
  strain S88 / ExPEC

SEQ ID NO: 21385 - protein, 430 aa, Escherichia coli O45:K1; identical to SEQ ID NO: 5758
  strain S88 / ExPEC

SEQ ID NO: 21386 - protein, 200 aa, Escherichia coli O45:K1; identical to SEQ ID NO: 5898
  strain S88 / ExPEC

SEQ ID NO: 21387 - protein, 274 aa, Escherichia coli O45:K1; identical to SEQ ID NO: 5899
  strain S88 / ExPEC

SEQ ID NO: 21388 - protein, 297 aa, Escherichia coli O45:K1
  strain S88 / ExPEC
MNKRERQPLILQRQKLSLLFRTRRGKSHQRKRRRQFQQLNNLIKERSMSYKLSCPMLVSTALMALLTTASLTAHASVTPDRTRLVFNESDKSISVTLRNNTEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRRPWQFKVTLTRSGQDYTVNNPTPYHVIISDASTQKKGLTAAGFKPLVMPPKTSQPLKAKMASAPVLTYINDYGARMPLIFRCEGNTCKVDEDQSSKG

SEQ ID NO: 21389 - protein, 884 aa, Escherichia coli O45:K1; identical to SEQ ID NO: 7607
  strain S88 / ExPEC

SEQ ID NO: 21390 - protein, 332 aa, Escherichia coli O45:K1; identical to SEQ ID NO: 5870
  strain S88 / ExPEC

SEQ ID NO: 21391 - protein, 760 aa, Escherichia coli O45:K1
  strain S88 / ExPEC
MENNRNFPARQFHSLTFFAGLCIGITPVAQALAAEGQANADDTLVVEASTPSLYAPQQSADPKFSRPVADTTRTMTVISEQVIKDQGATNLTDALKNVPAVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNIYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 21392 - protein, 208 aa, Escherichia coli O45:K1; identical to SEQ ID NO: 5869
  strain S88 / ExPEC

SEQ ID NO: 21393 - protein, 204 aa, Escherichia coli O45:K1; identical to SEQ ID NO: 5755
  strain S88 / ExPEC

SEQ ID NO: 21394 - protein, 362 aa, Escherichia coli O45:K1; identical to SEQ ID NO: 5874
  strain S88 / ExPEC

SEQ ID NO: 21395 - protein, 614 aa, Escherichia coli O45:K1; identical to SEQ ID NO: 7540
  strain S88 / ExPEC

SEQ ID NO: 21396 - protein, 110 aa, Escherichia coli O45:K1; identical to SEQ ID NO: 17794
  strain S88 / ExPEC

SEQ ID NO: 21397 - protein, 511 aa, Escherichia coli O45:K1; identical to SEQ ID NO: 5749
  strain S88 / ExPEC

SEQ ID NO: 21398 - protein, 191 aa, Escherichia coli O45:K1; identical to SEQ ID NO: 5748
  strain S88 / ExPEC

SEQ ID NO: 21399 - protein, 472 aa, Escherichia coli O45:K1
  strain S88 / ExPEC
MSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKDTKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDACALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 21400 - protein, 446 aa, Escherichia coli O45:K1; identical to SEQ ID NO: 5873
  strain S88 / ExPEC

SEQ ID NO: 21401 - protein, 232 aa, Escherichia coli O45:K1; identical to SEQ ID NO: 5747
  strain S88 / ExPEC

SEQ ID NO: 21402 - protein, 365 aa, Escherichia coli O45:K1; identical to SEQ ID NO: 6335
  strain S88 / ExPEC

SEQ ID NO: 21403 - protein, 729 aa, Escherichia coli O45:K1; identical to SEQ ID NO: 6821
  strain S88 / ExPEC

SEQ ID NO: 21404 - protein, 213 aa, Escherichia coli O45:K1; identical to SEQ ID NO: 5744
  strain S88 / ExPEC

SEQ ID NO: 21405 - protein, 380 aa, Escherichia coli O45:K1; identical to SEQ ID NO: 7505
  strain S88 / ExPEC

SEQ ID NO: 21406 - protein, 237 aa, Escherichia coli O45:K1; identical to SEQ ID NO: 7546
  strain S88 / ExPEC

SEQ ID NO: 21407 - protein, 478 aa, Escherichia coli O45:K1; identical to SEQ ID NO: 6796
  strain S88 / ExPEC

SEQ ID NO: 21408 - protein, 203 aa, Escherichia coli O45:K1; identical to SEQ ID NO: 7450
  strain S88 / ExPEC

SEQ ID NO: 21409 - protein, 663 aa, Escherichia coli O45:K1; identical to SEQ ID NO: 7630
  strain S88 / ExPEC

SEQ ID NO: 21410 - protein, 565 aa, Escherichia coli O45:K1; identical to SEQ ID NO: 7493
  strain S88 / ExPEC

SEQ ID NO: 21411 - protein, 207 aa, Escherichia coli O45:K1; identical to SEQ ID NO: 7443
  strain S88 / ExPEC

SEQ ID NO: 21412 - protein, 432 aa, Escherichia coli O45:K1; identical to SEQ ID NO: 5727
  strain S88 / ExPEC

SEQ ID NO: 21413 - protein, 774 aa, Escherichia coli O45:K1
  strain S88 / ExPEC
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDIFEHAGARDVIRREDFAKTGATTMREVLNRIPGVSAPENNGTGSHDLAMNFGIRGLSPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQIADLNLAFGVKNIFDQDYFIRSYDDNNKGIYAGQPRTLYMQGSLKF

SEQ ID NO: 21414 - protein, 368 aa, Escherichia coli O45:K1; identical to SEQ ID NO: 7728
  strain S88 / ExPEC

SEQ ID NO: 21415 - protein, 241 aa, Escherichia coli O45:K1; identical to SEQ ID NO: 6132
  strain S88 / ExPEC

SEQ ID NO: 21416 - protein, 878 aa, Escherichia coli O45:K1
  strain S88 / ExPEC
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDSNWTLSYSLTKNAWQKGRDQMLALNVNIPFSHWLRSDSKSQWRHASASYSMSHDLNGRMTNLVGVYGTLLEDNNLSYSVQTGYAGGGDGNSGSTGYATLNYRGGYGNANIGYSHSDDIKQLYYGVSGGILAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 21417 - protein, 541 aa, Escherichia coli O45:K1; identical to SEQ ID NO: 15907
  strain S88 / ExPEC

SEQ ID NO: 21418 - protein, 700 aa, Escherichia coli O45:K1
  strain S88 / ExPEC
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNRGVPEYGQKGELRRDERNLMWNVDPYLQTQWQLTDKLSLDAGVRYSSVWFDSNDHYVTPGNGDDSGDASYHKWLPAGSLKYAMTDAWNVYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMAFASIGYIPEDGWYAGTEARYMGDIMADDENTAKAPSYILVGLFTGYKYNYHNLTVDLFGRVDNLFDKEYVGSVIVNESNGRYYEPAPGRNYGVGINIAWRFE

SEQ ID NO: 21419 - protein, 359 aa, Escherichia coli O45:K1; identical to SEQ ID NO: 5847
  strain S88 / ExPEC

SEQ ID NO: 21420 - protein, 244 aa, Escherichia coli O45:K1; identical to SEQ ID NO: 6111
  strain S88 / ExPEC

SEQ ID NO: 21421 - protein, 843 aa, Escherichia coli O45:K1; identical to SEQ ID NO: 8766
  strain S88 / ExPEC

SEQ ID NO: 21422 - protein, 682 aa, Escherichia coli O45:K1; identical to SEQ ID NO: 6110
  strain S88 / ExPEC

SEQ ID NO: 21423 - protein, 686 aa, Escherichia coli O45:K1; identical to SEQ ID NO: 7542
  strain S88 / ExPEC

SEQ ID NO: 21424 - protein, 659 aa, Escherichia coli O55:H7; identical to SEQ ID NO: 5736
  strain CB9615 / EPEC

SEQ ID NO: 21425 - protein, 828 aa, Escherichia coli O55:H7
  strain CB9615 / EPEC
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQDVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQVEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 21426 - protein, 162 aa, Escherichia coli O55:H7; identical to SEQ ID NO: 5734
  strain CB9615 / EPEC

SEQ ID NO: 21427 - protein, 446 aa, Escherichia coli O55:H7; identical to SEQ ID NO: 5714
  strain CB9615 / EPEC

SEQ ID NO: 21428 - protein, 237 aa, Escherichia coli O55:H7; identical to SEQ ID NO: 5713
  strain CB9615 / EPEC

SEQ ID NO: 21429 - protein, 478 aa, Escherichia coli O55:H7; identical to SEQ ID NO: 5711
  strain CB9615 / EPEC

SEQ ID NO: 21430 - protein, 230 aa, Escherichia coli O55:H7; identical to SEQ ID NO: 5766
  strain CB9615 / EPEC

SEQ ID NO: 21431 - protein, 869 aa, Escherichia coli O55:H7; identical to SEQ ID NO: 12461
  strain CB9615 / EPEC

SEQ ID NO: 21432 - protein, 360 aa, Escherichia coli O55:H7; identical to SEQ ID NO: 8317
  strain CB9615 / EPEC

SEQ ID NO: 21433 - protein, 367 aa, Escherichia coli O55:H7; identical to SEQ ID NO: 5700
  strain CB9615 / EPEC

SEQ ID NO: 21434 - protein, 200 aa, Escherichia coli O55:H7; identical to SEQ ID NO: 5732
  strain CB9615 / EPEC

SEQ ID NO: 21435 - protein, 274 aa, Escherichia coli O55:H7; identical to SEQ ID NO: 5730
  strain CB9615 / EPEC

SEQ ID NO: 21436 - protein, 252 aa, Escherichia coli O55:H7; identical to SEQ ID NO: 12309
  strain CB9615 / EPEC

SEQ ID NO: 21437 - protein, 879 aa, Escherichia coli O55:H7
  strain CB9615 / EPEC
MPDHSLFRLRVLPCCVALAMSGSYVNAWAENEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEHYQSAALGVGRDLSVFGAVAFDITHSHTRLDKETAYGKGSLDGNSFRLSYSKDFDELNSRVTFAGYRFSEENFMTMSEYLDASDSEMVRTGNDKEMYTATYNQNFRDAGVSVYLNYTGHTYWDRDEQTNYNVMLSHYFNLGSIRNMSISMTGYRYEYDNQADKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQATLTEGAIGYRKFSVISGQKAMAVLRLQDGSYPPFGAEVKNDSAQNVGLVDDDGNVYLAGVKPGEHMIVSWGGVAHCDIHLPDPLPADLFNGLLLPCQQTGAISPSMPHEIKPVIQEQTQQVMPTEAPVSVSAN

SEQ ID NO: 21438 - protein, 746 aa, Escherichia coli O55:H7; identical to SEQ ID NO: 5761
  strain CB9615 / EPEC

SEQ ID NO: 21439 - protein, 193 aa, Escherichia coli O55:H7; identical to SEQ ID NO: 5760
  strain CB9615 / EPEC

SEQ ID NO: 21440 - protein, 241 aa, Escherichia coli O55:H7; identical to SEQ ID NO: 5709
  strain CB9615 / EPEC

SEQ ID NO: 21441 - protein, 878 aa, Escherichia coli O55:H7; identical to SEQ ID NO: 5706
  strain CB9615 / EPEC

SEQ ID NO: 21442 - protein, 243 aa, Escherichia coli O55:H7; identical to SEQ ID NO: 8524
  strain CB9615 / EPEC

SEQ ID NO: 21443 - protein, 816 aa, Escherichia coli O55:H7
  strain CB9615 / EPEC
MNIYRLSVLSCLAMVTPPALTAEFNLNVLDKSIRDSVDISLLNQKGVVAPGDYFVSVTVNNNKISNGQQIRWQKSGDKIIPCINESLIELFGLKSDFRKKLPAIKECVDFSVFPEIIFTFDQANQQLNITIPQAWLAWHSENWTPPSTWNNGIPGFLMDYNLFASTYRPQSGSSSNNLNAYGTTGLNAGAWRLRSDYQLSQSDSGDNREQSGAISRTYLFRPLPQIGSRLTLGETDFSSNIFDGFSYTGAALASDDRMLPWELRGYAPQISGIAQTNATVTISHSGRVIYQKKVPPGPFIIDDLNQSVQGTLDVKVSEEDGRVNNFQVSAASTPFLTRQGQVRYKLAAGRPRSSMSHHTEDETFISHEVSWGMLSNTSLYGGMLLAGDDYRSGALGIGQNMLWMGALSFDVTWADSHFDTQQDEQGYSYRFNYSKQVDATNSTISLAAYRFSDRHFHSYANYIDHKYNDADTQDEKQTISLSFGQPITLLNLNLYANILHQSWWNADTSTTANITVGFNVDIGDWKDISVSTSFNTTHYEDKDRDNQIYFSISLPIGESGRLGYDMQNNSNTTTHRMSWNDTLDERNSWGMSAGIQSDRPDNGAQVSGNYQHLSSAGEWDLTGTYAANDYTSASASWSGSFTATQHGAAFHRRSSTNEPRLMVSTDGVGDIPIQGNIDYTNRFGIAVVPFVSSYQPTTVAVNMNDLPDGVTVSENVVKETWTEGAIGFKSLASRAGKDLNVIISDANGHFPPLGADVRQAEGGVSVGMVGENGHAWLSGVDENQQFTVHWGDQKTCAIHLPEHLEDVTKRLILPCH

SEQ ID NO: 21444 - protein, 431 aa, Escherichia coli O55:H7
  strain CB9615 / EPEC
MMKQALRVAFGFLILWASVLHAEVRIVIDSGVDSGRPIGVVPFQWAGPGAAPEDIGGIVAADLRNSGKFNPLDRAHLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKFPAWSPYL

SEQ ID NO: 21445 - protein, 518 aa, Escherichia coli O55:H7; identical to SEQ ID NO: 6358
  strain CB9615 / EPEC

SEQ ID NO: 21446 - protein, 332 aa, Escherichia coli O55:H7
  strain CB9615 / EPEC
MMKKPVVIGLAVVVLAAVVAGGYWWYQSRQDNGLTLYGNVDIRTVNLSFRVGGRVESLAVDEGDAIKAGQVLGELDHKPYEIALMQAKAGVSVAQAQYDLMLAGYRDEEIAQAAAAVKQAQAAYDYAQNFYNRQQGLWKSRTISANDLENARSSRDQAQATLKSAQDKLRQYRSGNREQDIAQAKASLEQAQAQLAQAELNLQDSTLIAPSDGTLLTRAVEPGTVLNEGGTVFSVSLTRPVWVRAYVDERNLDQAQPGRKVLLYTDGRPDKPYHGQIGFVSPTAEFTPKTVETPDLRTDLVYRLRIVVTDADDALRQGMPVTVQFGDEAGHE

SEQ ID NO: 21447 - protein, 760 aa, Escherichia coli O55:H7; identical to SEQ ID NO: 5756
  strain CB9615 / EPEC

SEQ ID NO: 21448 - protein, 461 aa, Escherichia coli O55:H7
  strain CB9615 / EPEC
MTERELSIIRALGEEFSTVLADLQRTFEGKMASQAQAFEEKLTSLSAVLQKHVTVDEVRPVLQAMVDDAVGAIPVPRDGRDYDPDVLQQAVNDAVANIPVPADGKSITPDDVRPMLEQMVKEAVSHIPVPRDGRDYDPDVLQQAVNDAVANIPVPADGKSITPDDVRPMLEQMVKEAVSHIPVPRDGRDYDPEVLKQAVNDAVANIPVPADGKSITPDDVRPMLEQMVKEAVSHIPVPRDGRDYDPEVLQKAVNDAVANIPVPADGKSITPDDVRPMLEQMVKEAVSHIPVPRDGRDYDPDVLQKAVLDAVRALPAPQDGRDATALEIIPAIDDQKSFPRGTYATHQGGLWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRDAGGGK

SEQ ID NO: 21449 - protein, 204 aa, Escherichia coli O55:H7; identical to SEQ ID NO: 5755
  strain CB9615 / EPEC

SEQ ID NO: 21450 - protein, 362 aa, Escherichia coli O55:H7; identical to SEQ ID NO: 5754
  strain CB9615 / EPEC

SEQ ID NO: 21451 - protein, 233 aa, Escherichia coli O55:H7; identical to SEQ ID NO: 5752
  strain CB9615 / EPEC

SEQ ID NO: 21452 - protein, 245 aa, Escherichia coli O55:H7
  strain CB9615 / EPEC
MPARHLYFIMTNTWNRLALLIFAVLSLLVAGELQAGVVVGGTRFIFPADRESISILLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRKSQGVQLTNPTPYYINLIQVSVNGKALSNVGVVPPKSQRQTSWCQAIAPCHVAWRAINDYGGLSAKKEQNLP

SEQ ID NO: 21453 - protein, 432 aa, Escherichia coli O55:H7; identical to SEQ ID NO: 5727
  strain CB9615 / EPEC

SEQ ID NO: 21454 - protein, 229 aa, Escherichia coli O55:H7; identical to SEQ ID NO: 8514
  strain CB9615 / EPEC

SEQ ID NO: 21455 - protein, 840 aa, Escherichia coli O55:H7; identical to SEQ ID NO: 11380
  strain CB9615 / EPEC

SEQ ID NO: 21456 - protein, 240 aa, Escherichia coli O55:H7; identical to SEQ ID NO: 19624
  strain CB9615 / EPEC

SEQ ID NO: 21457 - protein, 511 aa, Escherichia coli O55:H7; identical to SEQ ID NO: 5749
  strain CB9615 / EPEC

SEQ ID NO: 21458 - protein, 191 aa, Escherichia coli O55:H7; identical to SEQ ID NO: 5748
  strain CB9615 / EPEC

SEQ ID NO: 21459 - protein, 232 aa, Escherichia coli O55:H7; identical to SEQ ID NO: 5747
  strain CB9615 / EPEC

SEQ ID NO: 21460 - protein, 366 aa, Escherichia coli O55:H7
  strain CB9615 / EPEC
MVIKFLSALILLLVTTAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNTLNLQLNDEDFSMAQQIADTINRVRGYGSATALDARTIQVRVPSGNSSQVRFLADIQNMQVNVTPQDAKVVINSRTGSVVMNREVTLDSCAIAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 21461 - protein, 726 aa, Escherichia coli O55:H7
  strain CB9615 / EPEC
MLSTQFNRDNQYQAITKPSLLAGCILLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 21462 - protein, 213 aa, Escherichia coli O55:H7; identical to SEQ ID NO: 5744
  strain CB9615 / EPEC

SEQ ID NO: 21463 - protein, 567 aa, Escherichia coli O55:H7; identical to SEQ ID NO: 12464
  strain CB9615 / EPEC

SEQ ID NO: 21464 - protein, 203 aa, Escherichia coli O55:H7; identical to SEQ ID NO: 6347
  strain CB9615 / EPEC

SEQ ID NO: 21465 - protein, 656 aa, Escherichia coli O55:H7; identical to SEQ ID NO: 12443
  strain CB9615 / EPEC

SEQ ID NO: 21466 - protein, 207 aa, Escherichia coli O55:H7; identical to SEQ ID NO: 5743
  strain CB9615 / EPEC

SEQ ID NO: 21467 - protein, 360 aa, Escherichia coli O55:H7; identical to SEQ ID NO: 5726
  strain CB9615 / EPEC

SEQ ID NO: 21468 - protein, 686 aa, Escherichia coli O55:H7; identical to SEQ ID NO: 6339
  strain CB9615 / EPEC

SEQ ID NO: 21469 - protein, 713 aa, Escherichia coli O55:H7; identical to SEQ ID NO: 11726
  strain CB9615 / EPEC

SEQ ID NO: 21470 - protein, 551 aa, Escherichia coli O55:H7; identical to SEQ ID NO: 5742
  strain CB9615 / EPEC

SEQ ID NO: 21471 - protein, 231 aa, Escherichia coli O55:H7; identical to SEQ ID NO: 5724
  strain CB9615 / EPEC

SEQ ID NO: 21472 - protein, 863 aa, Escherichia coli O55:H7; identical to SEQ ID NO: 19681
  strain CB9615 / EPEC

SEQ ID NO: 21473 - protein, 678 aa, Escherichia coli O55:H7; identical to SEQ ID NO: 5722
  strain CB9615 / EPEC

SEQ ID NO: 21474 - protein, 700 aa, Escherichia coli O55:H7; identical to SEQ ID NO: 5740
  strain CB9615 / EPEC

SEQ ID NO: 21475 - protein, 366 aa, Escherichia coli O55:H7; identical to SEQ ID NO: 12420
  strain CB9615 / EPEC

SEQ ID NO: 21476 - protein, 883 aa, Escherichia coli O55:H7
  strain CB9615 / EPEC
MTAFRAAFKAYRMHQVLLLPRFARLTIALSLATAVFPVDAEYYFNPRFLSNDLAESVDLSAFTKGREAPPGTYRVDIYLNDEFMTSRDITFITDDNNADLIPCLSTDLLVSLGIKKSALLDNKEHSAEKHVPDNSACTPLQDRLVDASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPRFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNLPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSTLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 21477 - protein, 239 aa, Escherichia coli O55:H7; identical to SEQ ID NO: 12299
  strain CB9615 / EPEC

SEQ ID NO: 21478 - protein, 412 aa, Escherichia coli O55:H7; identical to SEQ ID NO: 5719
  strain CB9615 / EPEC

SEQ ID NO: 21479 - protein, 104 aa, Escherichia coli O55:H7
  strain CB9615 / EPEC
MTMKKVLALVVAAAMGLSSAAFAAETATTPAPTATTTKAAPAKTTHHKKQHKAAPAQKAQAAKKHHKNTKAEQKAPEQKAQAAKKHAKKHSHQQPAKPAAQPAA

SEQ ID NO: 21480 - protein, 660 aa, Escherichia coli O55:H7; identical to SEQ ID NO: 11731
  strain CB9615 / EPEC

SEQ ID NO: 21481 - protein, 857 aa, Escherichia coli O55:H7; identical to SEQ ID NO: 12401
  strain CB9615 / EPEC

SEQ ID NO: 21482 - protein, 232 aa, Escherichia coli O55:H7
  strain CB9615 / EPEC
MDRMMKSKFVALALSLFLSQSVLAGGVGLSSTRVIYDGSKKEASLTVQNKSKTEEFLIQSWVDDAAGSKKTPFIITPPLFKLDPEKNNILRIVNITPGLPQDRESVYWVNVKAIPSKSDDSENKNVLQIAVRTRIKLFYRPAGLKGDVKTAPNELRFTRNGNQLRVDNPTVFNITFNQFFANDKEIEKAGMVPAKGALNITLPAGVGSVSKIKYNTINDFGSSAEMITKNVD

SEQ ID NO: 21483 - protein, 816 aa, Escherichia coli O55:H7; identical to SEQ ID NO: 11428
  strain CB9615 / EPEC

SEQ ID NO: 21484 - protein, 227 aa, Escherichia coli O55:H7; identical to SEQ ID NO: 11429
  strain CB9615 / EPEC

SEQ ID NO: 21485 - protein, 782 aa, Escherichia coli O55:H7
  strain CB9615 / EPEC
MKKRIPTLLATMIATALYSQQGLAADLASQCMLGVPSYDRPLVQGDTNDLPVTINADHAKGDYPDDAVFTGSVDIMQGNSRLQADEVQLHQAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 21486 - protein, 243 aa, Escherichia coli O55:H7
  strain CB9615 / EPEC
MLMFPLVKKTVSALFVSTLLASAPAFADIIISGTRIIYNADKKDVNVRLENKGNRPLLIQNWLDTGDDNADPSQIKVPFTATPPVSRVEPKRGQTVKVMYTGATALPKDRESVYWFNVLEVPPKPKDAEADKNLLQLAFRTRIKLFYRLSGLQGEPAEAPAKITWKLNNAQLQANNPTPYYVSFNEVKLESGGKTYNVNSSMVTPFSQASFGVTGLPGSVSSGKVVFKAINDFGGNIDGSATF

SEQ ID NO: 21487 - protein, 122 aa, Escherichia coli O55:H7; identical to SEQ ID NO: 5737
  strain CB9615 / EPEC

SEQ ID NO: 21488 - protein, 556 aa, Escherichia coli O55:H7
  strain CB9615 / EPEC
MPIGNLGHNPNVNNSIPPAPPLPSQTDGAGGRGQLINSTGPLGSRALFTPVRNSMADSGDNRASDVPGLPVNPMRLAASEITLNDGFEVLHDHGPLDTLNRQIGSSVFRVETQEDGKHIAVGQRNGVETSVVLSDQEYARLQSIDPEGKDKFVFTGGRGGAGHAMVTVASDITEARQRILELLEPKGTGESKGAGESKGVGELRESNSGAENTTETQTSTSTSSLRSDPKLWLALGTVATGLIGLAATGIVQALALTPEPDSPTTTDPDAAASATETATRDQLTKEAFQNPDNQKVNIDELGNAIPSGVLKDDVVANIEEQAKAAGEEAKQQAIENNAQAQKKYDEQQAKRQEELKVSSGAGYGLSGALILGGGIGVAVTAALHRKNQPVEQTTTTTTTTTSARTVENKPANNTPAQGNVDTPGSEDTMESRRSSMASTSSTFFDTSSIGTVQNPYADVKTSLHDSQVPTSNSNTSVQNMGNTDSVVYSTIQHPPRDTTDNGARLLGNPSAGIQSTYARLALSGGLRHDMGGLTGGSNSAVNTSNNPPAPGSHRFV

SEQ ID NO: 21489 - protein, 512 aa, Escherichia coli O55:H7; identical to SEQ ID NO: 5948
  strain CB9615 / EPEC

SEQ ID NO: 21490 - protein, 127 aa, Escherichia coli O55:H7; identical to SEQ ID NO: 19633
  strain CB9615 / EPEC

SEQ ID NO: 21491 - protein, 747 aa, Escherichia coli O55:H7
  strain CB9615 / EPEC
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANVYSKQCAALAPADKGHYLARKYVVDDEKLQNFSVDTQLQSKFATGDIDHTLLTGVDFMRMRNDINAWFGYDDSVPLLDLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 21492 - protein, 266 aa, Escherichia coli O55:H7; identical to SEQ ID NO: 5772
  strain CB9615 / EPEC

SEQ ID NO: 21493 - protein, 161 aa, Escherichia coli O55:H7; identical to SEQ ID NO: 5769
  strain CB9615 / EPEC

SEQ ID NO: 21494 - protein, 351 aa, Escherichia coli O55:H7; identical to SEQ ID NO: 5767
  strain CB9615 / EPEC

SEQ ID NO: 21495 - protein, 395 aa, Escherichia coli O55:H7; identical to SEQ ID NO: 12450
  strain CB9615 / EPEC

SEQ ID NO: 21496 - protein, 334 aa, Escherichia coli O55:H7; identical to SEQ ID NO: 19634
  strain CB9615 / EPEC

SEQ ID NO: 21497 - protein, 208 aa, Escherichia coli O55:H7; identical to SEQ ID NO: 5717
  strain CB9615 / EPEC

SEQ ID NO: 21498 - protein, 719 aa, Escherichia coli O55:H7
  strain CB9615 / EPEC
MRDEMLYNIPCRIYILSTLSLCISGIVSTATATSSETKISNEETLVVTTNRSASNLWETPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWQFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 21499 - protein, 614 aa, Escherichia coli O55:H7; identical to SEQ ID NO: 5716
  strain CB9615 / EPEC

SEQ ID NO: 21500 - protein, 94 aa, Escherichia coli O55:H7; identical to SEQ ID NO: 12316
  strain CB9615 / EPEC

SEQ ID NO: 21501 - protein, 656 aa, Escherichia coli O55:H7
  strain CB9615 / EPEC
MFRKWLNGRLSVFVFTTVFLSAIPGWGAEFSASFKDTDIQEFINTVSKNLHKTVIINPDVQGTITVRSYDMLNEEQYYQFFLSVLDVYGFAVVDMHNGILKVVRSKDAKTSAVPVASDASPGTGDEVVTRVVPVSNVAARDLAPLLRQLNDNAGAGSVVHYEPSNVLLMTGRAAVMKRLMEIVERVDKEGNRSVATVPLTYASATDVARLVTELTKESDKTAMPAWMTAKLVADERTNSVLVSGEPISQQRIISMIKQLDRKEDVQGNTKVIYLKYAKAKDLVEVLTGISSNIENDAKKSSSTEALRKGVTIKSHEQTNALILTGAPDVIRDLENVISQLDIRRPQVLVEAIIAEVQDADGLNLGIQWVNKHSGVTQFTSTGLPITTMVQTRQSDISDSDQSNTLSMFNGIAAGFYQGNWAMLLTALSTSSKNDILATPSIVTLDNMEATFNVGQEVPVLSGSQTTSGDNIFNTVERKTVGIKLRVKPQINEGDSVLLEIEQEVSGVADTAVATTTDLGATFNTRTVTNAMLVGNGETVVVGGLLDKSIRGSESKVPLLGDIPVLGHLFSSKSEHAAKRNLMLFIRPTIIRERDGFRHASAEKYLSFNQEQVQSRGKETMALTLNEEQLKLSRDRDDTTFRKVKTAIAAFYARGMQ

SEQ ID NO: 21502 - protein, 816 aa, Escherichia coli O55:H7 str. 3256-97; identical to SEQ ID NO: 11428

SEQ ID NO: 21503 - protein, 227 aa, Escherichia coli O55:H7 str. 3256-97
MRIITALLMSFFILPVHAGVVIYGTRIIYPEKNREVLVQLMNQSKNASLIQAWIDDGNTTIAPEKIQVTFILTPPVSRVAGGSGQLLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSHNDITLKNNHASEYELTVVDDYGNNIHSKIAAR

SEQ ID NO: 21504 - protein, 784 aa, Escherichia coli O55:H7 str. 3256-97; identical to SEQ ID NO: 6283

SEQ ID NO: 21505 - protein, 170 aa, Escherichia coli O55:H7 str. 3256-97; identical to SEQ ID NO: 5855

SEQ ID NO: 21506 - protein, 241 aa, Escherichia coli O55:H7 str. 3256-97; identical to SEQ ID NO: 12340

SEQ ID NO: 21507 - protein, 747 aa, Escherichia coli O55:H7 str. 3256-97; identical to SEQ ID NO: 12341

SEQ ID NO: 21508 - protein, 266 aa, Escherichia coli O55:H7 str. 3256-97; identical to SEQ ID NO: 5772

SEQ ID NO: 21509 - protein, 161 aa, Escherichia coli O55:H7 str. 3256-97; identical to SEQ ID NO: 5769

SEQ ID NO: 21510 - protein, 118 aa, Escherichia coli O55:H7 str. 3256-97 [sequence omitted]

SEQ ID NO: 21511 - protein, 394 aa, Escherichia coli O55:H7 str. 3256-97; identical to SEQ ID NO: 12380

SEQ ID NO: 21512 - protein, 715 aa, Escherichia coli O55:H7 str. 3256-97; identical to SEQ ID NO: 11710

SEQ ID NO: 21513 - protein, 224 aa, Escherichia coli O55:H7 str. 3256-97; identical to SEQ ID NO: 6435

SEQ ID NO: 21514 - protein, 659 aa, Escherichia coli O55:H7 str. 3256-97; identical to SEQ ID NO: 5736

SEQ ID NO: 21515 - protein, 828 aa, Escherichia coli O55:H7 str. 3256-97; identical to SEQ ID NO: 5735

SEQ ID NO: 21516 - protein, 162 aa, Escherichia coli O55:H7 str. 3256-97; identical to SEQ ID NO: 5734

SEQ ID NO: 21517 - protein, 367 aa, Escherichia coli O55:H7 str. 3256-97; identical to SEQ ID NO: 12384

SEQ ID NO: 21518 - protein, 200 aa, Escherichia coli O55:H7 str. 3256-97; identical to SEQ ID NO: 5732

SEQ ID NO: 21519 - protein, 274 aa, Escherichia coli O55:H7 str. 3256-97; identical to SEQ ID NO: 5730

SEQ ID NO: 21520 - protein, 252 aa, Escherichia coli O55:H7 str. 3256-97; identical to SEQ ID NO: 12309

SEQ ID NO: 21521 - protein, 879 aa, Escherichia coli O55:H7 str. 3256-97; identical to SEQ ID NO: 19287

SEQ ID NO: 21522 - protein, 518 aa, Escherichia coli O55:H7 str. 3256-97; identical to SEQ ID NO: 6358

SEQ ID NO: 21523 - protein, 244 aa, Escherichia coli O55:H7 str. 3256-97
DDMRPMLEQMVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRHSSGQRTEKTFSLPVMLYRGVFRAGETYHPGDTVTWGGSLWHCNSMTADKPGDAHASGWTLAAKRGRDAGGGK

SEQ ID NO: 21524 - protein, 567 aa, Escherichia coli O55:H7 str. 3256-97; identical to SEQ ID NO: 12391

SEQ ID NO: 21525 - protein, 359 aa, Escherichia coli O55:H7 str. 3256-97; identical to SEQ ID NO: 11410

SEQ ID NO: 21526 - protein, 432 aa, Escherichia coli O55:H7 str. 3256-97; identical to SEQ ID NO: 5727

SEQ ID NO: 21527 - protein, 686 aa, Escherichia coli O55:H7 str. 3256-97; identical to SEQ ID NO: 6339

SEQ ID NO: 21528 - protein, 713 aa, Escherichia coli O55:H7 str. 3256-97; identical to SEQ ID NO: 11726

SEQ ID NO: 21529 - protein, 231 aa, Escherichia coli O55:H7 str. 3256-97; identical to SEQ ID NO: 5724

SEQ ID NO: 21530 - protein, 838 aa, Escherichia coli O55:H7 str. 3256-97; identical to SEQ ID NO: 12397

SEQ ID NO: 21531 - protein, 678 aa, Escherichia coli O55:H7 str. 3256-97; identical to SEQ ID NO: 5722

SEQ ID NO: 21532 - protein, 412 aa, Escherichia coli O55:H7 str. 3256-97; identical to SEQ ID NO: 5719

SEQ ID NO: 21533 - protein, 660 aa, Escherichia coli O55:H7 str. 3256-97; identical to SEQ ID NO: 11731

SEQ ID NO: 21534 - protein, 857 aa, Escherichia coli O55:H7 str. 3256-97; identical to SEQ ID NO: 12401

SEQ ID NO: 21535 - protein, 228 aa, Escherichia coli O55:H7 str. 3256-97; identical to SEQ ID NO: 12402

SEQ ID NO: 21536 - protein, 512 aa, Escherichia coli O55:H7 str. 3256-97; identical to SEQ ID NO: 5948

SEQ ID NO: 21537 - protein, 108 aa, Escherichia coli O55:H7 str. 3256-97; identical to SEQ ID NO: 11583

SEQ ID NO: 21538 - protein, 208 aa, Escherichia coli O55:H7 str. 3256-97; identical to SEQ ID NO: 5717

SEQ ID NO: 21539 - protein, 614 aa, Escherichia coli O55:H7 str. 3256-97; identical to SEQ ID NO: 5716

SEQ ID NO: 21540 - protein, 445 aa, Escherichia coli O55:H7 str. 3256-97; identical to SEQ ID NO: 12556

SEQ ID NO: 21541 - protein, 237 aa, Escherichia coli O55:H7 str. 3256-97
MRKITQAISAVCLLFALNSSAVALASFPSPLNPGTNVARLAEQAPIHWVSVAQIENSLAGRPPMAVGFDIDDTVLFSSPGFWRGKKNFSPESEDYLKNPVFWEKMNNGWDEFSIPKEVARQLIDMHVRRGDAIFFVTGRSPTKTETVSKTLADNFHIPATSMNPVIFAGDKPGQNTKSQWLQDKNIRIFYGDSDNDITAARDVGARGIRILRASNSTYKPLPQAGAFGEEVIVNSEY

SEQ ID NO: 21542 - protein, 478 aa, Escherichia coli O55:H7 str. 3256-97; identical to SEQ ID NO: 12409

SEQ ID NO: 21543 - protein, 368 aa, Escherichia coli O55:H7 str. 3256-97; identical to SEQ ID NO: 11425

SEQ ID NO: 21544 - protein, 241 aa, Escherichia coli O55:H7 str. 3256-97; identical to SEQ ID NO: 5709

SEQ ID NO: 21545 - protein, 878 aa, Escherichia coli O55:H7 str. 3256-97
MSYLNLRLYQRNTQCLHIRKHRLAGFFVRLFVACAFAVQAPLSSAELYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPSESQQQLLTQLSAECR

SEQ ID NO: 21546 - protein, 351 aa, Escherichia coli O55:H7 str. 3256-97; identical to SEQ ID NO: 5767

SEQ ID NO: 21547 - protein, 230 aa, Escherichia coli O55:H7 str. 3256-97; identical to SEQ ID NO: 5765

SEQ ID NO: 21548 - protein, 869 aa, Escherichia coli O55:H7 str. 3256-97; identical to SEQ ID NO: 12351

SEQ ID NO: 21549 - protein, 746 aa, Escherichia coli O55:H7 str. 3256-97; identical to SEQ ID NO: 5761

SEQ ID NO: 21550 - protein, 193 aa, Escherichia coli O55:H7 str. 3256-97; identical to SEQ ID NO: 5760

SEQ ID NO: 21551 - protein, 243 aa, Escherichia coli O55:H7 str. 3256-97; identical to SEQ ID NO: 8524

SEQ ID NO: 21552 - protein, 816 aa, Escherichia coli O55:H7 str. 3256-97; identical to SEQ ID NO: 12355

SEQ ID NO: 21553 - protein, 430 aa, Escherichia coli O55:H7 str. 3256-97; identical to SEQ ID NO: 5758

SEQ ID NO: 21554 - protein, 331 aa, Escherichia coli O55:H7 str. 3256-97; identical to SEQ ID NO: 6551

SEQ ID NO: 21555 - protein, 760 aa, Escherichia coli O55:H7 str. 3256-97; identical to SEQ ID NO: 5756

SEQ ID NO: 21556 - protein, 203 aa, Escherichia coli O55:H7 str. 3256-97; identical to SEQ ID NO: 6414

SEQ ID NO: 21557 - protein, 362 aa, Escherichia coli O55:H7 str. 3256-97
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQLLGNGKKAEQWATGLKYDANNIYLAANYGETRNATPITNKFTNISGFANKTQDVLLVAQYQFDFGLRPSIAYTKSKAKDVEGIGDVDLVNYFEVGATYYFNKNMSTYVDYIINQIDSDNKLGVASDDTVAVGIVYQF

SEQ ID NO: 21558 - protein, 233 aa, Escherichia coli O55:H7 str. 3256-97; identical to SEQ ID NO: 5752

SEQ ID NO: 21559 - protein, 229 aa, Escherichia coli O55:H7 str. 3256-97; identical to SEQ ID NO: 20935

SEQ ID NO: 21560 - protein, 229 aa, Escherichia coli O55:H7 str. 3256-97; identical to SEQ ID NO: 8514

SEQ ID NO: 21561 - protein, 840 aa, Escherichia coli O55:H7 str. 3256-97; identical to SEQ ID NO: 11380

SEQ ID NO: 21562 - protein, 233 aa, Escherichia coli O55:H7 str. 3256-97; identical to SEQ ID NO: 11381

SEQ ID NO: 21563 - protein, 517 aa, Escherichia coli O55:H7 str. 3256-97; identical to SEQ ID NO: 6817

SEQ ID NO: 21564 - protein, 191 aa, Escherichia coli O55:H7 str. 3256-97; identical to SEQ ID NO: 5748

SEQ ID NO: 21565 - protein, 232 aa, Escherichia coli O55:H7 str. 3256-97; identical to SEQ ID NO: 5747

SEQ ID NO: 21566 - protein, 729 aa, Escherichia coli O55:H7 str. 3256-97; identical to SEQ ID NO: 5745

SEQ ID NO: 21567 - protein, 213 aa, Escherichia coli O55:H7 str. 3256-97; identical to SEQ ID NO: 5744

SEQ ID NO: 21568 - protein, 203 aa, Escherichia coli O55:H7 str. 3256-97; identical to SEQ ID NO: 6347

SEQ ID NO: 21569 - protein, 656 aa, Escherichia coli O55:H7 str. 3256-97; identical to SEQ ID NO: 11774

SEQ ID NO: 21570 - protein, 207 aa, Escherichia coli O55:H7 str. 3256-97; identical to SEQ ID NO: 5743

SEQ ID NO: 21571 - protein, 407 aa, Escherichia coli O55:H7 str. 3256-97
MTERELSIIRALGEEFATVLADLQRTFEEKMAAQAQAFEEKLASLSAVLQKCVTVDEVHPVLQAMVDDAVGTIPVPRDGRDYDPDVLQQAVNDAVANIPVPADGKSITPDDVRPMLEQMVKEAVSHIPAPRDGRDYDPEVLKQVVNDAVGSIPVPADGKSLTPDDVRPMLEQMVKEAVSHIPVPRDGRDYDPEVLKQAVNDAVAKIPVPADGKSITPDDVRPMLEQMVKEAVSHIPAPRDGRDYDPDVLRKAVLEAVNALPAPQDGRDATALEVLPAIDDQKSFPRGTYATHLGGFWRAYEKTHGMRGWECLVDGVADIDVSMTGERLFSVVIRHSSGQRTEKTFSLPVMLYRGVFRAGETYHPGDTVTWGGSLWHCNSMTGDKPGEAHASGWTLAAKRGRDAGGGK

SEQ ID NO: 21572 - protein, 539 aa, Escherichia coli O55:H7 str. 3256-97; identical to SEQ ID NO: 6525

SEQ ID NO: 21573 - protein, 700 aa, Escherichia coli O55:H7 str. 3256-97; identical to SEQ ID NO: 12375

SEQ ID NO: 21574 - protein, 366 aa, Escherichia coli O55:H7 str. 3256-97; identical to SEQ ID NO: 11362

SEQ ID NO: 21575 - protein, 883 aa, Escherichia coli O55:H7 str. 3256-97
MTAFRAAFKAYRMHQVLLLPRFARLTIALSLATAVFPVDAEYYFNPRFLSNDLAESVDLSAFTKGREAPPGTYRVDIYLNDEFMTSRDITFITDDNNADLIPCLSTDLLVSLGIKKSALLDNKEHSAEKHVPDNSACTPLQDRLVDASTEFDVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPRFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSTLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 21576 - protein, 239 aa, Escherichia coli O55:H7 str. 3256-97; identical to SEQ ID NO: 12299

SEQ ID NO: 21577 - protein, 111 aa, Escherichia coli O55:H7 str. 3256-97; identical to SEQ ID NO: 5738

SEQ ID NO: 21578 - protein, 746 aa, Escherichia coli O55:H7 str. RM12579; identical to SEQ ID NO: 5761

SEQ ID NO: 21579 - protein, 243 aa, Escherichia coli O55:H7 str. RM12579; identical to SEQ ID NO: 8524

SEQ ID NO: 21580 - protein, 816 aa, Escherichia coli O55:H7 str. RM12579; identical to SEQ ID NO: 11682

SEQ ID NO: 21581 - protein, 430 aa, Escherichia coli O55:H7 str. RM12579; identical to SEQ ID NO: 5759

SEQ ID NO: 21582 - protein, 203 aa, Escherichia coli O55:H7 str. RM12579; identical to SEQ ID NO: 6414

SEQ ID NO: 21583 - protein, 362 aa, Escherichia coli O55:H7 str. RM12579; identical to SEQ ID NO: 5754

SEQ ID NO: 21584 - protein, 203 aa, Escherichia coli O55:H7 str. RM12579; identical to SEQ ID NO: 6347

SEQ ID NO: 21585 - protein, 656 aa, Escherichia coli O55:H7 str. RM12579; identical to SEQ ID NO: 12443

SEQ ID NO: 21586 - protein, 207 aa, Escherichia coli O55:H7 str. RM12579; identical to SEQ ID NO: 5743

SEQ ID NO: 21587 - protein, 366 aa, Escherichia coli O55:H7 str. RM12579; identical to SEQ ID NO: 12420

SEQ ID NO: 21588 - protein, 883 aa, Escherichia coli O55:H7 str. RM12579; identical to SEQ ID NO: 21476

SEQ ID NO: 21589 - protein, 236 aa, Escherichia coli O55:H7 str. RM12579; identical to SEQ ID NO: 11364

SEQ ID NO: 21590 - protein, 395 aa, Escherichia coli O55:H7 str. RM12579; identical to SEQ ID NO: 12450

SEQ ID NO: 21591 - protein, 274 aa, Escherichia coli O55:H7 str. RM12579; identical to SEQ ID NO: 5730

SEQ ID NO: 21592 - protein, 252 aa, Escherichia coli O55:H7 str. RM12579; identical to SEQ ID NO: 12309

SEQ ID NO: 21593 - protein, 879 aa, Escherichia coli O55:H7 str. RM12579; identical to SEQ ID NO: 21437

SEQ ID NO: 21594 - protein, 686 aa, Escherichia coli O55:H7 str. RM12579; identical to SEQ ID NO: 6339

SEQ ID NO: 21595 - protein, 512 aa, Escherichia coli O55:H7 str. RM12579; identical to SEQ ID NO: 5948

SEQ ID NO: 21596 - protein, 193 aa, Escherichia coli O55:H7 str. RM12579; identical to SEQ ID NO: 5760

SEQ ID NO: 21597 - protein, 233 aa, Escherichia coli O55:H7 str. RM12579; identical to SEQ ID NO: 5753

SEQ ID NO: 21598 - protein, 229 aa, Escherichia coli O55:H7 str. RM12579; identical to SEQ ID NO: 20935

SEQ ID NO: 21599 - protein, 407 aa, Escherichia coli O55:H7 str. RM12579; identical to SEQ ID NO: 12294

SEQ ID NO: 21600 - protein, 715 aa, Escherichia coli O55:H7 str. RM12579; identical to SEQ ID NO: 12451

SEQ ID NO: 21601 - protein, 713 aa, Escherichia coli O55:H7 str. RM12579; identical to SEQ ID NO: 11726

SEQ ID NO: 21602 - protein, 127 aa, Escherichia coli O55:H7 str. RM12579; identical to SEQ ID NO: 19633

SEQ ID NO: 21603 - protein, 331 aa, Escherichia coli O55:H7 str. RM12579; identical to SEQ ID NO: 6551

SEQ ID NO: 21604 - protein, 760 aa, Escherichia coli O55:H7 str. RM12579; identical to SEQ ID NO: 5756

SEQ ID NO: 21605 - protein, 229 aa, Escherichia coli O55:H7 str. RM12579; identical to SEQ ID NO: 8514

SEQ ID NO: 21606 - protein, 840 aa, Escherichia coli O55:H7 str. RM12579; identical to SEQ ID NO: 11380

SEQ ID NO: 21607 - protein, 233 aa, Escherichia coli O55:H7 str. RM12579; identical to SEQ ID NO: 11381

SEQ ID NO: 21608 - protein, 511 aa, Escherichia coli O55:H7 str. RM12579; identical to SEQ ID NO: 5749

SEQ ID NO: 21609 - protein, 191 aa, Escherichia coli O55:H7 str. RM12579; identical to SEQ ID NO: 5748

SEQ ID NO: 21610 - protein, 111 aa, Escherichia coli O55:H7 str. RM12579; identical to SEQ ID NO: 5738

SEQ ID NO: 21611 - protein, 518 aa, Escherichia coli O55:H7 str. RM12579; identical to SEQ ID NO: 6358

SEQ ID NO: 21612 - protein, 231 aa, Escherichia coli O55:H7 str. RM12579; identical to SEQ ID NO: 5724

SEQ ID NO: 21613 - protein, 838 aa, Escherichia coli O55:H7 str. RM12579; identical to SEQ ID NO: 5723

SEQ ID NO: 21614 - protein, 678 aa, Escherichia coli O55:H7 str. RM12579; identical to SEQ ID NO: 5722

SEQ ID NO: 21615 - protein, 232 aa, Escherichia coli O55:H7 str. RM12579; identical to SEQ ID NO: 5747

SEQ ID NO: 21616 - protein, 729 aa, Escherichia coli O55:H7 str. RM12579; identical to SEQ ID NO: 5745

SEQ ID NO: 21617 - protein, 213 aa, Escherichia coli O55:H7 str. RM12579; identical to SEQ ID NO: 5744

SEQ ID NO: 21618 - protein, 208 aa, Escherichia coli O55:H7 str. RM12579; identical to SEQ ID NO: 5717

SEQ ID NO: 21619 - protein, 551 aa, Escherichia coli O55:H7 str. RM12579; identical to SEQ ID NO: 5742

SEQ ID NO: 21620 - protein, 700 aa, Escherichia coli O55:H7 str. RM12579; identical to SEQ ID NO: 5740

SEQ ID NO: 21621 - protein, 614 aa, Escherichia coli O55:H7 str. RM12579; identical to SEQ ID NO: 5716

SEQ ID NO: 21622 - protein, 118 aa, Escherichia coli O55:H7 str. RM12579 [sequence omitted]

SEQ ID NO: 21623 - protein, 659 aa, Escherichia coli O55:H7 str. RM12579; identical to SEQ ID NO: 5736

SEQ ID NO: 21624 - protein, 162 aa, Escherichia coli O55:H7 str. RM12579; identical to SEQ ID NO: 5734

SEQ ID NO: 21625 - protein, 367 aa, Escherichia coli O55:H7 str. RM12579; identical to SEQ ID NO: 5700

SEQ ID NO: 21626 - protein, 432 aa, Escherichia coli O55:H7 str. RM12579; identical to SEQ ID NO: 5727

SEQ ID NO: 21627 - protein, 412 aa, Escherichia coli O55:H7 str. RM12579; identical to SEQ ID NO: 5719

SEQ ID NO: 21628 - protein, 446 aa, Escherichia coli O55:H7 str. RM12579; identical to SEQ ID NO: 5714

SEQ ID NO: 21629 - protein, 200 aa, Escherichia coli O55:H7 str. RM12579; identical to SEQ ID NO: 5732

SEQ ID NO: 21630 - protein, 567 aa, Escherichia coli O55:H7 str. RM12579; identical to SEQ ID NO: 12464

SEQ ID NO: 21631 - protein, 237 aa, Escherichia coli O55:H7 str. RM12579; identical to SEQ ID NO: 5713

SEQ ID NO: 21632 - protein, 478 aa, Escherichia coli O55:H7 str. RM12579; identical to SEQ ID NO: 5711

SEQ ID NO: 21633 - protein, 359 aa, Escherichia coli O55:H7 str. RM12579; identical to SEQ ID NO: 12465

SEQ ID NO: 21634 - protein, 660 aa, Escherichia coli O55:H7 str. RM12579; identical to SEQ ID NO: 12471

SEQ ID NO: 21635 - protein, 857 aa, Escherichia coli O55:H7 str. RM12579; identical to SEQ ID NO: 12473

SEQ ID NO: 21636 - protein, 228 aa, Escherichia coli O55:H7 str. RM12579
MKSKFVALALSLFLSQSVLAGGVGLSSTRVIYDCSKKEASLTVQNKSKTEEFLIQSWVDDAAGSKKTPFIITPPLFKLDPEKNNILRIVNITPGLPQDRESVYWVNVKAIPSKSDDSENKNVLQIAVRTRIKLFYRPAGLKGDVKTAPNELRFTRNGNQLRVDNPTVFNITFNQFFANDKEIEKAGMVPAKGALNITLPAGVGSVSKIKYNTINDFGSSAEMITKNVD

SEQ ID NO: 21637 - protein, 368 aa, Escherichia coli O55:H7 str. RM12579; identical to SEQ ID NO: 11425

SEQ ID NO: 21638 - protein, 241 aa, Escherichia coli O55:H7 str. RM12579; identical to SEQ ID NO: 5710

SEQ ID NO: 21639 - protein, 878 aa, Escherichia coli O55:H7 str. RM12579; identical to SEQ ID NO: 5708

SEQ ID NO: 21640 - protein, 816 aa, Escherichia coli O55:H7 str. RM12579; identical to SEQ ID NO: 11428

SEQ ID NO: 21641 - protein, 227 aa, Escherichia coli O55:H7 str. RM12579; identical to SEQ ID NO: 11429

SEQ ID NO: 21642 - protein, 782 aa, Escherichia coli O55:H7 str. RM12579; identical to SEQ ID NO: 21485

SEQ ID NO: 21643 - protein, 170 aa, Escherichia coli O55:H7 str. RM12579; identical to SEQ ID NO: 5855

SEQ ID NO: 21644 - protein, 241 aa, Escherichia coli O55:H7 str. RM12579; identical to SEQ ID NO: 12415

SEQ ID NO: 21645 - protein, 747 aa, Escherichia coli O55:H7 str. RM12579; identical to SEQ ID NO: 5775

SEQ ID NO: 21646 - protein, 266 aa, Escherichia coli O55:H7 str. RM12579; identical to SEQ ID NO: 5772

SEQ ID NO: 21647 - protein, 161 aa, Escherichia coli O55:H7 str. RM12579; identical to SEQ ID NO: 5769

SEQ ID NO: 21648 - protein, 351 aa, Escherichia coli O55:H7 str. RM12579; identical to SEQ ID NO: 5768

SEQ ID NO: 21649 - protein, 230 aa, Escherichia coli O55:H7 str. RM12579; identical to SEQ ID NO: 5766

SEQ ID NO: 21650 - protein, 869 aa, Escherichia coli O55:H7 str. RM12579; identical to SEQ ID NO: 12461

SEQ ID NO: 21651 - protein, 87 aa, Escherichia coli O55:H7 str. RM12579; identical to SEQ ID NO: 12583

SEQ ID NO: 21652 - protein, 651 aa, Escherichia coli O55:H7 str. RM12579; identical to SEQ ID NO: 12315

SEQ ID NO: 21653 - protein, 816 aa, Escherichia coli O55:H7 str. USDA 5905; identical to SEQ ID NO: 11428

SEQ ID NO: 21654 - protein, 227 aa, Escherichia coli O55:H7 str. USDA 5905; identical to SEQ ID NO: 11429

SEQ ID NO: 21655 - protein, 782 aa, Escherichia coli O55:H7 str. USDA 5905; identical to SEQ ID NO: 21485

SEQ ID NO: 21656 - protein, 170 aa, Escherichia coli O55:H7 str. USDA 5905
MSGILTRWRQFGKRYFWPHLLLGMVAASLGLPALSNAAEPNAPAKATTRNHEPSAKVNFGQLALLEANTRRPNSNYSVDYWHQHAIRTVIRHLSFAMAPQTLPVAEESLPLQAQHLALLDTLSALLTQEGTPSEKDYRIDYAHFTPQAKFSTPVWISQAQGIRAGPQRLS

SEQ ID NO: 21657 - protein, 241 aa, Escherichia coli O55:H7 str. USDA 5905; identical to SEQ ID NO: 12415

SEQ ID NO: 21658 - protein, 747 aa, Escherichia coli O55:H7 str. USDA 5905; identical to SEQ ID NO: 5775

SEQ ID NO: 21659 - protein, 266 aa, Escherichia coli O55:H7 str. USDA 5905; identical to SEQ ID NO: 5772

SEQ ID NO: 21660 - protein, 161 aa, Escherichia coli O55:H7 str. USDA 5905; identical to SEQ ID NO: 5769

SEQ ID NO: 21661 - protein, 715 aa, Escherichia coli O55:H7 str. USDA 5905; identical to SEQ ID NO: 11710

SEQ ID NO: 21662 - protein, 224 aa, Escherichia coli O55:H7 str. USDA 5905; identical to SEQ ID NO: 6435

SEQ ID NO: 21663 - protein, 659 aa, Escherichia coli O55:H7 str. USDA 5905; identical to SEQ ID NO: 5736

SEQ ID NO: 21664 - protein, 828 aa, Escherichia coli O55:H7 str. USDA 5905
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFVVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQDVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 21665 - protein, 162 aa, Escherichia coli O55:H7 str. USDA 5905; identical to SEQ ID NO: 12597

SEQ ID NO: 21666 - protein, 367 aa, Escherichia coli O55:H7 str. USDA 5905; identical to SEQ ID NO: 5700

SEQ ID NO: 21667 - protein, 200 aa, Escherichia coli O55:H7 str. USDA 5905; identical to SEQ ID NO: 5732

SEQ ID NO: 21668 - protein, 274 aa, Escherichia coli O55:H7 str. USDA 5905; identical to SEQ ID NO: 5730

SEQ ID NO: 21669 - protein, 252 aa, Escherichia coli O55:H7 str. USDA 5905; identical to SEQ ID NO: 12309

SEQ ID NO: 21670 - protein, 879 aa, Escherichia coli O55:H7 str. USDA 5905
MPDHSLFRLRVLPCCVALAMSGSYVNAWAENEIQFDSRFLELKGDTKIDLKRFSSQGYVEPGKYNLQVQLNKQPLTEEYDIYWYASENDASKTYACLTPELVAQFGLKEDVAKNLQWIHDGKCLKPGQLEGIDIKADLSQSALVISLPQAYLEYTDINWDPPSRWDDGISGLIADYSITAQTRHEENGGDDSNEISGNGTVGVNLGAWRLRADWQTDYLHSKSNDDDVINGDDTQKNWEWSRYYAWRALPSLKAKLGLGEDYLNSDIFDGFNYVGGSISTDDQMLPPNLRGYAPDISGVAHTTAKVTVSQLGRVIYETQVPAGPFRIQDLGDSVSGTLHIRIEEQNGQVQEYDINTASMPFLTRPGQVRYKLMMGRPQEWGHHVEGGFFSGGEASWGIANGWSLYGGALADEYYQSAALGVGRDLSVFGAVAFDITHSHTRLDKETAYGKGSLDGNSFRLSYSKDFDELNSRVTFAGYRFSEENFMTMSEYLDASDSEMVRTGNDKEMYTATYNQNFRDAGVSVYLNYTGHTYWDRDEQTNYNVMLSHYFNLGSIRNMSISMTGYRYEYDNQADKGVYISLSMPWGDSSTISYNGNYGSGSDSSQVGYFSRVDDATHYQLNVGTSDNHSSVDGYYSHDGSLAQVDLSANYHEGQYTSAGISLQGGATLTAQGGALHRTQNMGGTRLLIDADGVAGVPVEGNGAAVYTNMFGKAVVADVNNYYRNQAYIDLNNLPENAEATQSVVQATLTEGAIGYRKFSVISGQKAMAVLRLQDGSYPPFGAEVKNDSAQNVGLVDDDGNVYLAGVKPGEHMIVSWGGVAHCDIHLPDPLPADLFNGLLLPCQQTGSISPSMPHEIKPVIQEQTQQVMPTEAPVSVSAN

SEQ ID NO: 21671 - protein, 518 aa, Escherichia coli O55:H7 str. USDA 5905; identical to SEQ ID NO: 6358

SEQ ID NO: 21672 - protein, 270 aa, Escherichia coli O55:H7 str. USDA 5905
PEVLKQAVNDAVANIPVPADGKSITPDDMRPMLEQMVKEAVSHIPVPRDGRDYDPEVLQKAVNDAVANIPQPADGKSLTPDDVRPMLEQMVKEAVSHIPVPRDGRDYDPDVLQKAVLDAVSALPAPQDGRDATALEIIPAIDDQKSFPRGTYATHQGGLWRAYEKTHGMRGWECLVDGVADIDVSMTGERSFTVVVRQSSGQRTEKTFSLPVMLYRGVFRAGETYHPGDTVTWGGSLWHCNSMTGDKPGEAHSSGWTLAAKRGRDAGGGK

SEQ ID NO: 21673 - protein, 432 aa, Escherichia coli O55:H7 str. USDA 5905; identical to SEQ ID NO: 5727

SEQ ID NO: 21674 - protein, 567 aa, Escherichia coli O55:H7 str. USDA 5905
MKIKLRITIILISVLCIFNGLFTPGAYAAAANGYVANKENLRSFFETVSSYAGKPTIVSKLAMKKQISGNFDLTEPYALIERLSAQMGLIWYDDGKAIYIYDSSEMRNALINLRKVSTNEFNNFLKKSGLYNSRYEIKGDGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFAARNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 21675 - protein, 359 aa, Escherichia coli O55:H7 str. USDA 5905; identical to SEQ ID NO: 11410

SEQ ID NO: 21676 - protein, 686 aa, Escherichia coli O55:H7 str. USDA 5905
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVIGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 21677 - protein, 713 aa, Escherichia coli O55:H7 str. USDA 5905
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIGPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 21678 - protein, 231 aa, Escherichia coli O55:H7 str. USDA 5905; identical to SEQ ID NO: 5724

SEQ ID NO: 21679 - protein, 838 aa, Escherichia coli O55:H7 str. USDA 5905; identical to SEQ ID NO: 5723

SEQ ID NO: 21680 - protein, 678 aa, Escherichia coli O55:H7 str. USDA 5905; identical to SEQ ID NO: 5722

SEQ ID NO: 21681 - protein, 412 aa, Escherichia coli O55:H7 str. USDA 5905; identical to SEQ ID NO: 5719

SEQ ID NO: 21682 - protein, 660 aa, Escherichia coli O55:H7 str. USDA 5905; identical to SEQ ID NO: 11731

SEQ ID NO: 21683 - protein, 228 aa, Escherichia coli O55:H7 str. USDA 5905; identical to SEQ ID NO: 11499

SEQ ID NO: 21684 - protein, 512 aa, Escherichia coli O55:H7 str. USDA 5905; identical to SEQ ID NO: 5948

SEQ ID NO: 21685 - protein, 127 aa, Escherichia coli O55:H7 str. USDA 5905; identical to SEQ ID NO: 19633

SEQ ID NO: 21686 - protein, 208 aa, Escherichia coli O55:H7 str. USDA 5905; identical to SEQ ID NO: 5717

SEQ ID NO: 21687 - protein, 614 aa, Escherichia coli O55:H7 str. USDA 5905; identical to SEQ ID NO: 5716

SEQ ID NO: 21688 - protein, 445 aa, Escherichia coli O55:H7 str. USDA 5905; identical to SEQ ID NO: 12556

SEQ ID NO: 21689 - protein, 237 aa, Escherichia coli O55:H7 str. USDA 5905; identical to SEQ ID NO: 5713

SEQ ID NO: 21690 - protein, 368 aa, Escherichia coli O55:H7 str. USDA 5905; identical to SEQ ID NO: 11425

SEQ ID NO: 21691 - protein, 241 aa, Escherichia coli O55:H7 str. USDA 5905; identical to SEQ ID NO: 5709

SEQ ID NO: 21692 - protein, 878 aa, Escherichia coli O55:H7 str. USDA 5905; identical to SEQ ID NO: 5706

SEQ ID NO: 21693 - protein, 478 aa, Escherichia coli O55:H7 str. USDA 5905; identical to SEQ ID NO: 5711

SEQ ID NO: 21694 - protein, 230 aa, Escherichia coli O55:H7 str. USDA 5905; identical to SEQ ID NO: 5766

SEQ ID NO: 21695 - protein, 869 aa, Escherichia coli O55:H7 str. USDA 5905
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAVMRLNITIPQIALLSSAHGYIPPEEWDEGVPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSSNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 21696 - protein, 351 aa, Escherichia coli O55:H7 str. USDA 5905; identical to SEQ ID NO: 5767

SEQ ID NO: 21697 - protein, 746 aa, Escherichia coli O55:H7 str. USDA 5905; identical to SEQ ID NO: 5761

SEQ ID NO: 21698 - protein, 193 aa, Escherichia coli O55:H7 str. USDA 5905; identical to SEQ ID NO: 5760

SEQ ID NO: 21699 - protein, 243 aa, Escherichia coli O55:H7 str. USDA 5905; identical to SEQ ID NO: 8524

SEQ ID NO: 21700 - protein, 816 aa, Escherichia coli O55:H7 str. USDA 5905; identical to SEQ ID NO: 12337

SEQ ID NO: 21701 - protein, 430 aa, Escherichia coli O55:H7 str. USDA 5905; identical to SEQ ID NO: 5758

SEQ ID NO: 21702 - protein, 331 aa, Escherichia coli O55:H7 str. USDA 5905; identical to SEQ ID NO: 6551

SEQ ID NO: 21703 - protein, 760 aa, Escherichia coli O55:H7 str. USDA 5905
MENNRNFPARQFHSLTFFAGLCIGITPVAQALAAEGQTNADDTLVVEASTPSLYALQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAERDKVKNERYGVAPSIAFGLGTANRLYLNYLHVTQHNTPDGGIPTIGLPGYSAPSAGTATLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTASIGHDVSTGVEFTRETQTNYGVNPVTLPAVNIYHPDSSIHPGGLTRNDANANGQTDTFAIYAFDTLQITRDFELNGGIRLDNYHTEYDSATACGGSGRGAITCPAGVAKGSPVTAVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDEGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 21704 - protein, 203 aa, Escherichia coli O55:H7 str. USDA 5905; identical to SEQ ID NO: 6414

SEQ ID NO: 21705 - protein, 362 aa, Escherichia coli O55:H7 str. USDA 5905; identical to SEQ ID NO: 5754

SEQ ID NO: 21706 - protein, 233 aa, Escherichia coli O55:H7 str. USDA 5905; identical to SEQ ID NO: 5752

SEQ ID NO: 21707 - protein, 229 aa, Escherichia coli O55:H7 str. USDA 5905; identical to SEQ ID NO: 20935

SEQ ID NO: 21708 - protein, 229 aa, Escherichia coli O55:H7 str. USDA 5905; identical to SEQ ID NO: 8514

SEQ ID NO: 21709 - protein, 840 aa, Escherichia coli O55:H7 str. USDA 5905
MNKSVVSISAAMLVLLCQPVMGSEISPATPSDEDNYTFDPQLFRGSRFSQSSLAKLTTRESVAPGNYKMDIYTNNKLSGSWNVTFKEAADGRVLPCLTPEVADAIGLKTGEDKGEKDPVCTFAKELAPGITSQTQLSQLRLDLSVPQSQLISRPRGYVPPSELDTGASLAFMNYIANYYNVAYSGQNAHSQRSLWASFNGGINLGAWQYRQLSNMTWDNDKGNQWNNIRSYLQRPLPAINSQLMMGQLITSGRFFSGLSYHGVSLATDERMLPDSMRGYAPTIRGVAATNARVSVMQNGHEIYQTTVAPGPFEINDLYPTSYSGDLDVTVTEANGAVSRFSVPFSAVPESMRPGTSRYNVEVGKTQDSGDDSMFGDLTWQHGMTNTLTFNSGSRIADGYQALMLGGVYGSSLGAFGANLTWSHARVPESEAQSGWMSQLTWSKTFQPTSTTVSLAGYRYSTSGYRDLADVLGERHAASNKQSWDSSQWRQQSRFDLTLSQSLANYGNLFVSGSTQNYRGGKSRDTQLQLGYSNSFSHGISMNLSVGRQRMGGYKDNSDDMQTVTSLSFSFPLGGNGPRVPSLSNSWTHSTDGSSQLQSSLTGMLDEAQTTNYSLNVMRDQQYKQTTLSGNMQKRFSQTIVGLNASKGQDYWQASGNVQGAMAVHGGGITFGPYLGETFALVEAKGAEGAKVYNSSQLEINDSGYALVPAVTPYRYNRISLDPQGMDGDAELVDSERQVAPVAGAAVKVIFRTRPGKALLIKSRMADGSELPMGADVLDENNTVVGIAGQGGQIYLRTEQTKGHLSVRWGEGANDSCQLPFDISGKDSNSPIIRLNETCQS

SEQ ID NO: 21710 - protein, 233 aa, Escherichia coli O55:H7 str. USDA 5905; identical to SEQ ID NO: 11381

SEQ ID NO: 21711 - protein, 517 aa, Escherichia coli O55:H7 str. USDA 5905; identical to SEQ ID NO: 6817

SEQ ID NO: 21712 - protein, 191 aa, Escherichia coli O55:H7 str. USDA 5905; identical to SEQ ID NO: 5748

SEQ ID NO: 21713 - protein, 232 aa, Escherichia coli O55:H7 str. USDA 5905; identical to SEQ ID NO: 5747

SEQ ID NO: 21714 - protein, 729 aa, Escherichia coli O55:H7 str. USDA 5905; identical to SEQ ID NO: 5745

SEQ ID NO: 21715 - protein, 213 aa, Escherichia coli O55:H7 str. USDA 5905; identical to SEQ ID NO: 5744

SEQ ID NO: 21716 - protein, 203 aa, Escherichia coli O55:H7 str. USDA 5905; identical to SEQ ID NO: 6347

SEQ ID NO: 21717 - protein, 656 aa, Escherichia coli O55:H7 str. USDA 5905
MRLKKHYLCTALSLAFTQQAVAAQESDSLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSELGYLQVSDSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFVNEDTLALSYYDRKRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTQYAYSEGFIEEGRNFWAGVEYTF

SEQ ID NO: 21718 - protein, 207 aa, Escherichia coli O55:H7 str. USDA 5905
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEIIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 21719 - protein, 407 aa, Escherichia coli O55:H7 str. USDA 5905; identical to SEQ ID NO: 12294

SEQ ID NO: 21720 - protein, 539 aa, Escherichia coli O55:H7 str. USDA 5905; identical to SEQ ID NO: 6525

SEQ ID NO: 21721 - protein, 700 aa, Escherichia coli O55:H7 str. USDA 5905; identical to SEQ ID NO: 5740

SEQ ID NO: 21722 - protein, 366 aa, Escherichia coli O55:H7 str. USDA 5905; identical to SEQ ID NO: 12420

SEQ ID NO: 21723 - protein, 883 aa, Escherichia coli O55:H7 str. USDA 5905; identical to SEQ ID NO: 21575

SEQ ID NO: 21724 - protein, 239 aa, Escherichia coli O55:H7 str. USDA 5905; identical to SEQ ID NO: 12299

SEQ ID NO: 21725 - protein, 111 aa, Escherichia coli O55:H7 str. USDA 5905; identical to SEQ ID NO: 5738

SEQ ID NO: 21726 - protein, 118 aa, Escherichia coli O55:H7 str. USDA 5905 [sequence omitted]

SEQ ID NO: 21727 - protein, 395 aa, Escherichia coli O55:H7 str. USDA 5905; identical to SEQ ID NO: 12302

SEQ ID NO: 21728 - protein, 208 aa, Escherichia coli O6:H1; identical to SEQ ID NO: 5869
  strain CFT073 / ATCC 700928 / UPEC

SEQ ID NO: 21729 - protein, 222 aa, Escherichia coli O6:H1; identical to SEQ ID NO: 5850
  strain CFT073 / ATCC 700928 / UPEC

SEQ ID NO: 21730 - protein, 432 aa, Escherichia coli O6:H1; identical to SEQ ID NO: 5727
  strain CFT073 / ATCC 700928 / UPEC

SEQ ID NO: 21731 - protein, 430 aa, Escherichia coli O6:H1; identical to SEQ ID NO: 5758
  strain CFT073 / ATCC 700928 / UPEC

SEQ ID NO: 21732 - protein, 168 aa, Escherichia coli O6:H1; identical to SEQ ID NO: 7087
  strain CFT073 / ATCC 700928 / UPEC

SEQ ID NO: 21733 - protein, 171 aa, Escherichia coli O6:H1; identical to SEQ ID NO: 7096
  strain CFT073 / ATCC 700928 / UPEC

SEQ ID NO: 21734 - protein, 113 aa, Escherichia coli O6:H1; identical to SEQ ID NO: 7103
  strain CFT073 / ATCC 700928 / UPEC

SEQ ID NO: 21735 - protein, 810 aa, Escherichia coli O6:H1; identical to SEQ ID NO: 6345
  strain CFT073 / ATCC 700928 / UPEC

SEQ ID NO: 21736 - protein, 124 aa, Escherichia coli O6:H1; identical to SEQ ID NO: 7106
  strain CFT073 / ATCC 700928 / UPEC

SEQ ID NO: 21737 - protein, 86 aa, Escherichia coli O6:H1; identical to SEQ ID NO: 7109
  strain CFT073 / ATCC 700928 / UPEC

SEQ ID NO: 21738 - protein, 306 aa, Escherichia coli O6:H1; identical to SEQ ID NO: 7111
  strain CFT073 / ATCC 700928 / UPEC

SEQ ID NO: 21739 - protein, 85 aa, Escherichia coli O6:H1; identical to SEQ ID NO: 7114
  strain CFT073 / ATCC 700928 / UPEC

SEQ ID NO: 21740 - protein, 188 aa, Escherichia coli O6:H1; identical to SEQ ID NO: 7116
  strain CFT073 / ATCC 700928 / UPEC

SEQ ID NO: 21741 - protein, 428 aa, Escherichia coli O6:H1; identical to SEQ ID NO: 7118
  strain CFT073 / ATCC 700928 / UPEC

SEQ ID NO: 21742 - protein, 245 aa, Escherichia coli O6:H1 [sequence omitted]

SEQ ID NO: 21743 - protein, 367 aa, Escherichia coli O6:H1; identical to SEQ ID NO: 7121
  strain CFT073 / ATCC 700928 / UPEC

SEQ ID NO: 21744 - protein, 208 aa, Escherichia coli O6:H1; identical to SEQ ID NO: 7122
  strain CFT073 / ATCC 700928 / UPEC

SEQ ID NO: 21745 - protein, 193 aa, Escherichia coli O6:H1; identical to SEQ ID NO: 6300
  strain CFT073 / ATCC 700928 / UPEC

SEQ ID NO: 21746 - protein, 185 aa, Escherichia coli O6:H1; identical to SEQ ID NO: 7125
  strain CFT073 / ATCC 700928 / UPEC

SEQ ID NO: 21747 - protein, 166 aa, Escherichia coli O6:H1; identical to SEQ ID NO: 7128
  strain CFT073 / ATCC 700928 / UPEC

SEQ ID NO: 21748 - protein, 332 aa, Escherichia coli O6:H1; identical to SEQ ID NO: 7131
  strain CFT073 / ATCC 700928 / UPEC

SEQ ID NO: 21749 - protein, 318 aa, Escherichia coli O6:H1; identical to SEQ ID NO: 7134
  strain CFT073 / ATCC 700928 / UPEC

SEQ ID NO: 21750 - protein, 266 aa, Escherichia coli O6:H1; identical to SEQ ID NO: 7135
  strain CFT073 / ATCC 700928 / UPEC

SEQ ID NO: 21751 - protein, 248 aa, Escherichia coli O6:H1; identical to SEQ ID NO: 7136
  strain CFT073 / ATCC 700928 / UPEC

SEQ ID NO: 21752 - protein, 260 aa, Escherichia coli O6:H1; identical to SEQ ID NO: 7138
  strain CFT073 / ATCC 700928 / UPEC

SEQ ID NO: 21753 - protein, 161 aa, Escherichia coli O6:H1; identical to SEQ ID NO: 5769
  strain CFT073 / ATCC 700928 / UPEC

SEQ ID NO: 21754 - protein, 91 aa, Escherichia coli O6:H1; identical to SEQ ID NO: 7141
  strain CFT073 / ATCC 700928 / UPEC

SEQ ID NO: 21755 - protein, 91 aa, Escherichia coli O6:H1; identical to SEQ ID NO: 7142
  strain CFT073 / ATCC 700928 / UPEC

SEQ ID NO: 21756 - protein, 201 aa, Escherichia coli O6:H1; identical to SEQ ID NO: 7143
  strain CFT073 / ATCC 700928 / UPEC

SEQ ID NO: 21757 - protein, 190 aa, Escherichia coli O6:H1; identical to SEQ ID NO: 7146
  strain CFT073 / ATCC 700928 / UPEC

SEQ ID NO: 21758 - protein, 359 aa, Escherichia coli O6:H1; identical to SEQ ID NO: 5847
  strain CFT073 / ATCC 700928 / UPEC

SEQ ID NO: 21759 - protein, 203 aa, Escherichia coli O6:H1; identical to SEQ ID NO: 7450
  strain CFT073 / ATCC 700928 / UPEC

SEQ ID NO: 21760 - protein, 241 aa, Escherichia coli O6:H1; identical to SEQ ID NO: 6139
  strain CFT073 / ATCC 700928 / UPEC

SEQ ID NO: 21761 - protein, 203 aa, Escherichia coli O6:H1; identical to SEQ ID NO: 6414
  strain CFT073 / ATCC 700928 / UPEC

SEQ ID NO: 21762 - protein, 170 aa, Escherichia coli O6:H1; identical to SEQ ID NO: 5855
  strain CFT073 / ATCC 700928 / UPEC

SEQ ID NO: 21763 - protein, 75 aa, Escherichia coli O6:H1; identical to SEQ ID NO: 6027
  strain CFT073 / ATCC 700928 / UPEC

SEQ ID NO: 21764 - protein, 178 aa, Escherichia coli O6:H1; identical to SEQ ID NO: 6028
  strain CFT073 / ATCC 700928 / UPEC

SEQ ID NO: 21765 - protein, 227 aa, Escherichia coli O6:H1; identical to SEQ ID NO: 6029
  strain CFT073 / ATCC 700928 / UPEC

SEQ ID NO: 21766 - protein, 417 aa, Escherichia coli O6:H1; identical to SEQ ID NO: 7276
  strain CFT073 / ATCC 700928 / UPEC

SEQ ID NO: 21767 - protein, 112 aa, Escherichia coli O6:H1; identical to SEQ ID NO: 7277
  strain CFT073 / ATCC 700928 / UPEC

SEQ ID NO: 21768 - protein, 191 aa, Escherichia coli O6:H1; identical to SEQ ID NO: 7278
  strain CFT073 / ATCC 700928 / UPEC

SEQ ID NO: 21769 - protein, 87 aa, Escherichia coli O6:H1; identical to SEQ ID NO: 7279
  strain CFT073 / ATCC 700928 / UPEC

SEQ ID NO: 21770 - protein, 270 aa, Escherichia coli O6:H1; identical to SEQ ID NO: 19542
  strain CFT073 / ATCC 700928 / UPEC

SEQ ID NO: 21771 - protein, 511 aa, Escherichia coli O6:H1; identical to SEQ ID NO: 5749
  strain CFT073 / ATCC 700928 / UPEC

SEQ ID NO: 21772 - protein, 134 aa, Escherichia coli O6:H1; identical to SEQ ID NO: 7281
  strain CFT073 / ATCC 700928 / UPEC

SEQ ID NO: 21773 - protein, 372 aa, Escherichia coli O6:H1; identical to SEQ ID NO: 7283
  strain CFT073 / ATCC 700928 / UPEC

SEQ ID NO: 21774 - protein, 78 aa, Escherichia coli O6:H1; identical to SEQ ID NO: 7284
  strain CFT073 / ATCC 700928 / UPEC

SEQ ID NO: 21775 - protein, 721 aa, Escherichia coli O6:H1; identical to SEQ ID NO: 6807
  strain CFT073 / ATCC 700928 / UPEC

SEQ ID NO: 21776 - protein, 878 aa, Escherichia coli O6:H1; identical to SEQ ID NO: 6809
  strain CFT073 / ATCC 700928 / UPEC

SEQ ID NO: 21777 - protein, 238 aa, Escherichia coli O6:H1
  strain CFT073 / ATCC 700928 / UPEC
MKKAKILSGVLLLCFSSPLISQAATLDVRGGYRSGSHAYETRLKVSEGWQNGWWASMESNTWNTIHDNKKENAALNDVQVEVNYAIKLDDQWTVRPGMLTHFSSNGTRYGPYVKLSWDATKDLKFGIRYRYDWKAYRQQDLSGDMSRDNVHRWDGYVTYHINSDFTFAWQTTLYSKQNDYRYANHKKWATENAFVLQYHMTPDITPYIEYDYLDRQGVYNGRDNLSENSYRIGVSFKL

SEQ ID NO: 21778 - protein, 368 aa, Escherichia coli O6:H1; identical to SEQ ID NO: 8204
  strain CFT073 / ATCC 700928 / UPEC

SEQ ID NO: 21779 - protein, 128 aa, Escherichia coli O6:H1
  strain CFT073 / ATCC 700928 / UPEC
MRKSLLAILAVSSLVFSSASFAADLEDNMETLNDNLKVVEKADNAVQVKDALTKMRAAALDAQKATPPKLEGKSPDSPEMKDFRHGFDILVGQIDDALKLANEGKVKEAQAAAEQLKTTRNAYHQKYR

SEQ ID NO: 21780 - protein, 488 aa, Escherichia coli O6:H1
  strain CFT073 / ATCC 700928 / UPEC
MINRQLSRLLLCSILGSTTLISGCALVRKDSAPHQQLKPEQIKLADDIHLASSGWPQAQWWKQLNDPQLDSLIQRTLSGSHPLAEAKLREEKAQSQADLLDAGSQLQVAALGMLNRQRVSANGFLSPYAMDAPALGMDGPYYTEATVGLFAGLDLDLWGVHRSAVAAAIGAHNAALAETAAVELSLTTGVAQLYYSMQASYQMLDLLEQTRDVIDYAVKAHQSKVAHGLEAQVPFHGARAQILAVDKQIAAVKGQITETRESLRALIGAGASDMPEIKPVALPRVQTGIPATLSYELLARRPDLQAMRWYVQASLDQVDSARALFYPSFDIKAFFGLDSIHLDTLFKKTSRQFNFIPGLKLPLFDGGRLNANLEGTRAASNMMIERYNQSVLNAVRDVAVNGTRLQTLNDEREMQAERVEATRFTQRAAEAAYQRGLTSRLQATEARLPVLAEEMSLLMLDSRRVIQSIQLMKSLGGGYQAAPIVEKK

SEQ ID NO: 21781 - protein, 478 aa, Escherichia coli O6:H1; identical to SEQ ID NO: 6796
  strain CFT073 / ATCC 700928 / UPEC

SEQ ID NO: 21782 - protein, 237 aa, Escherichia coli O6:H1; identical to SEQ ID NO: 7546
  strain CFT073 / ATCC 700928 / UPEC

SEQ ID NO: 21783 - protein, 446 aa, Escherichia coli O6:H1; identical to SEQ ID NO: 5873
  strain CFT073 / ATCC 700928 / UPEC

SEQ ID NO: 21784 - protein, 139 aa, Escherichia coli O6:H1
  strain CFT073 / ATCC 700928 / UPEC
MKRNTKIALVMMALSAMAMGSTSAFAHGGHGMWQQNAAPLTSEQQTAWQKIHNDFYAQSSALQQQLVTKRYEYNALLAANPPDSSKINAVAKEMENLRQSLDELRVKRDIAMAEAGIPRGTGMGYGGCGGGGHMGMGHW

SEQ ID NO: 21785 - protein, 614 aa, Escherichia coli O6:H1
  strain CFT073 / ATCC 700928 / UPEC
  MOD_RES (609)..(609): Any amino acid
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGSYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLXGSYTF

SEQ ID NO: 21786 - protein, 538 aa, Escherichia coli O6:H1
  strain CFT073 / ATCC 700928 / UPEC
MFRRNIITSAILLMAPLAFSAQSLAESLTVEQRLELLEKALRETQSELKKYKDEEKKKYTPATVNRSVSTNDQGYAANPFPTSRAAKPDAVLVKNEEKNASETGSIYSSMTLKDFSKFVKDEIGFSYNGYYRSGWGTASHGSPKSWAIGSLGRFGNEYSGWFDLQLKQRVYNENGKRVDAIVMMDGNVGQQYSTGWFGDNAGGENFMQFSDMYVTTKGFLPFAPEADFWVGKHGAPKIEIQMLDWKTQRTDAAAGVGLENWKVGPGKIDIALVREDVDDYDRSLQNKQQINTNTIDLRYKDIPLWDKATLMVSGRYVSANESASEKDNQDNNGYYDWKETWMFGTSLTQKFDKGGFNEFSFLVANNSIASNFGRYAGASPFTTFNGRYYGDHTGGTAVRLTSQGEAYIGDHFIVANAIVYSFGNDIYSYETGAHSDFESIRAVVRPAYIWDQYNQTGVELGYFTQQNKDANSNKYNESGYKTTLFHTFKVNTSMLTSRPEIRFYATYIKALENELDGFTFEDNKDDQFAVGAQAEIWW

SEQ ID NO: 21787 - protein, 438 aa, Escherichia coli O6:H1; identical to SEQ ID NO: 7593
  strain CFT073 / ATCC 700928 / UPEC

SEQ ID NO: 21788 - protein, 259 aa, Escherichia coli O6:H1; identical to SEQ ID NO: 6832
  strain CFT073 / ATCC 700928 / UPEC

SEQ ID NO: 21789 - protein, 265 aa, Escherichia coli O6:H1; identical to SEQ ID NO: 6831
  strain CFT073 / ATCC 700928 / UPEC

SEQ ID NO: 21790 - protein, 412 aa, Escherichia coli O6:H1; identical to SEQ ID NO: 6828
  strain CFT073 / ATCC 700928 / UPEC

SEQ ID NO: 21791 - protein, 900 aa, Escherichia coli O6:H1; identical to SEQ ID NO: 6827
  strain CFT073 / ATCC 700928 / UPEC

SEQ ID NO: 21792 - protein, 654 aa, Escherichia coli O6:H1; identical to SEQ ID NO: 6816
  strain CFT073 / ATCC 700928 / UPEC

SEQ ID NO: 21793 - protein, 249 aa, Escherichia coli O6:H1; identical to SEQ ID NO: 5852
  strain CFT073 / ATCC 700928 / UPEC

SEQ ID NO: 21794 - protein, 840 aa, Escherichia coli O6:H1; identical to SEQ ID NO: 5851
  strain CFT073 / ATCC 700928 / UPEC

SEQ ID NO: 21795 - protein, 372 aa, Escherichia coli O6:H1
  strain CFT073 / ATCC 700928 / UPEC
MITMKVKNFIYLPFCLFIGTSVAGALPEIPEPFKYGVGGIENGKIYIGLGSLGNNWYMIDTNQSEKKWTKIAQWPTVPREQATATIIDGKIYVFGGIGKDTSGVITLQKDVYSYDIAKDKWEKLMTRPPVSLAGHVSFIHNGHAVSTGGVNENIFNGYFSDVELSKGNSALTEKVNRDYFSKPADDYFLNNHIISYDPSKNQWKNLGTTPFPGTAGSSVIFAEQQIYILGGERKPGLRSVRSWTGELSHDRIKWSELPPVASPEGVSGAYASVIDGNIFLAGGAYFPGAAEKYSNGEYWSHKGLDKAYSKEIYQLIKNDWKKVGSLPEGLAYGVSLPWQGGMLILGGEKKDGKAVSDVIYLKKNDKQIKIVK

SEQ ID NO: 21796 - protein, 962 aa, Escherichia coli O6:H1
  strain CFT073 / ATCC 700928 / UPEC
MPRSIWFKALLLFVALWAPLSQAETGWQPIQETIRKSDKDNRQYQAIRLDNGMVVLLVSDPQAVKSLSALVVPVGSLEDPEAYQGLAHYLEHMSLMGSKKYPQADSLAEYLKMHGGSHNASTAPYRTAFYLEVENDALPGAVDRLADAIAEPLLDKKYAERERNAVNAELTMARTRDGMRMAQVSAETINPAHPGSKFSGGNLETLSDKPGNPVQQALKDFHEKYYSANLMKAVIYSNKPLPELAKMAADTFGRVPNKESKKPEITVPVVTDAQKGIIIHYVPALPRKVLRVEFRIDNNSAKFRSKTDELITYLIGNRSPGTLSDWLQKQGLVEGISANSDPIVNGNSGVLAISASLTDKGLANRDQVVAAIFSYLNLLREKGIDKQYFDELANVLDIDFRYPSITRDMDYVEWLADTMIRVPVEHTLDAVNIADRYDAKAVKERLAMMTPQNARIWYISPKEPHNKTAYFVDAPYQVDKISEQTFADWQKKAANIALSLPELNPYIPDDFSLIKSEKKYDHPELIVDESNLRVVYAPSRYFASEPKADVSLILRNPKAMDSARNQVMFALNDYLAGLALDQLSNQASVGGISFSTNANNGLMVNANGYTQRLPQLFQALLEGYFSYTATEDQLEQAKSWYNQMMDSAEKGKAFEQAIMPAQMLSQVPYFSRDERRKILPSITLKEVLAYRDALKSGARPEFMVIGNMTEAQATTLARHVQKQLGADGSEWCRNKDVVVDKKQSVIFEKAGNSTDSALAAIFVPTGYDEYTSSAYSSLLGQIVQPWFYNQLRTEEQLGYAVFAFPMSVGRQWGMGFLLQSNDKQPSFLWERYKAFFPTAEAKLRTMKPEEFAQIQQAVITQMLQAPQTLGEEASKLSKDFDRGNMRFDSRDKIVAQIKLLTPQKLADFFHQAVVEPQGMAILSQISGSQNGKAEYVHPEGWKVWENVSALQQTMPLMSEKNE

SEQ ID NO: 21797 - protein, 446 aa, Escherichia coli O6:H1
  strain CFT073 / ATCC 700928 / UPEC
MSQKTLFTKSALAVAVALISTQAWSAGFQLNEFSSSGLGRAYSGEGAIADDAGNVSRNPALITMFDRPTFSAGAVYIDPDVDITGHSDLTGQSANAKNIAPTAWVPNLHFVAPINDQFGWGASITSNYGLATEFTDNYAAGIYGGKTDLQTINLNLSGAYRLNNSWSFGLGFDAVYAKAKIERYAGSLGPLLSQQLIAQGVPASLTNGINTPDSQIAHLKGDEWGFGWNAGILYELDKDNRWGLTYRSEVKIDFDGDYKSSINPNLNNILGNMGLPYGTMGATQNGSLTLNLPEMWEISGYNRVAPQWAIHYSMAYTSWSQFQELKAKGDSGQTLFYKDEGFRDAYRIALGTTYYYDKNWTFRTGIAYDDSPVPADKRSISIPDQDRLWLSAGLTYAFNEDASIDVGASYMHGQKVKFTEGEGAAAYSFESEGKAWLFGTNFNYAF

SEQ ID NO: 21798 - protein, 250 aa, Escherichia coli O6:H1; identical to SEQ ID NO: 6150
  strain CFT073 / ATCC 700928 / UPEC

SEQ ID NO: 21799 - protein, 274 aa, Escherichia coli O6:H1; identical to SEQ ID NO: 5899
  strain CFT073 / ATCC 700928 / UPEC

SEQ ID NO: 21800 - protein, 375 aa, Escherichia coli O6:H1; identical to SEQ ID NO: 5922
  strain CFT073 / ATCC 700928 / UPEC

SEQ ID NO: 21801 - protein, 162 aa, Escherichia coli O6:H1; identical to SEQ ID NO: 5896
  strain CFT073 / ATCC 700928 / UPEC

SEQ ID NO: 21802 - protein, 828 aa, Escherichia coli O6:H1; identical to SEQ ID NO: 6558
  strain CFT073 / ATCC 700928 / UPEC

SEQ ID NO: 21803 - protein, 690 aa, Escherichia coli O6:H1; identical to SEQ ID NO: 7614
  strain CFT073 / ATCC 700928 / UPEC

SEQ ID NO: 21804 - protein, 224 aa, Escherichia coli O6:H1; identical to SEQ ID NO: 5893
  strain CFT073 / ATCC 700928 / UPEC

SEQ ID NO: 21805 - protein, 831 aa, Escherichia coli O6:H1
  strain CFT073 / ATCC 700928 / UPEC
  MOD_RES (520)..(520): Any amino acid
MQELPMLRMTPLASAIVALLIGIEAYAAEETFDTHFMIGGMKDQQVSNIRLEDNQPLPGPYDIDIYVNKQWRGKYEIIVKDNPQETCLSREMIKRLGINTDSFASGKQCLTFKQLIQGGSYTWDIGVFRLDFSVPQAWVEDLESGYVPPENWERGINAFYTSYYVSQYYSDYKASGNSKSTYVRFNSGLNLQGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSIQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRXGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 21806 - protein, 673 aa, Escherichia coli O6:H1; identical to SEQ ID NO: 6170
  strain CFT073 / ATCC 700928 / UPEC

SEQ ID NO: 21807 - protein, 342 aa, Escherichia coli O6:H1; identical to SEQ ID NO: 7621
  strain CFT073 / ATCC 700928 / UPEC

SEQ ID NO: 21808 - protein, 809 aa, Escherichia coli O6:H1
  strain CFT073 / ATCC 700928 / UPEC
MTLTRREFIKHSGIAAGTLVVTSAAPLPAWAEEKGGKILTAGRWGAMNVEVKDGKIVSSTGALAKTIPNSLQSTAADQVHTTARIQHPMVRKSYLDNPLQPVKGRGEDTYVQVSWEQALKLIHEQHDRIRKANGPSAIFAGSYGWRSSGVLHKAQTLLQRYMNLAGGYSGHSGDYSTGAAQVIMPHVVGSVEVYEQQTSWPLILENSQVVVLWGMNPLNTLKIAWSSTDEQGLEYFHQLKKSGKPVIAIDPIRSETIEFFGDNATWIAPNMGTDVALMLGIAHTLMTQGKHDKVFLEKYTTGYPQFEEYLTGKSDNTPKSAAWAAEITGVPEAQIVKLAELMAANRTMLMAGWGIQRQQYGEQKHWMLVTLAAMLGQIGTPGGGFGFSYHYSNGGNPTRVGGVLPEMSAAIAGQASEAADDGGMTAIPVARIVDALENPGGKYQHNGKEQTYPNIKMIWWAGGGNFTHHQDTNRLIKAWQKPEMIVVSECYWTAAAKHADIVLPITTSFERNDLTMTGDYSNQHIVLMKQAVAPQFEARNDFDVFADLAELLKPGGKEIYTEGKDEMAWLKFFYDAAQKGARAQRVTMPMFNAFWQQNKLIEMRRSEKNEQYIRYGDFRADPVKNALGTPSGKIEIYSRTLEKFGYKDCPAHPTWLAPDEWKGTADEKQLQLLTAHPAHRLHSQLNYAELRKKYAVADREPITIHTEDAARFGIANGDLVRVWNKRGQILTGAVVTDGIKKGVVCVHEGAWPDLENGLCKNGSANVLTADIPSSQLANACAGNSALVYIEKYTGNALKLTAFDQPAVQA

SEQ ID NO: 21809 - protein, 118 aa, Escherichia coli O6:H1 [sequence omitted]

SEQ ID NO: 21810 - protein, 102 aa, Escherichia coli O6:H1; identical to SEQ ID NO: 14041
  strain CFT073 / ATCC 700928 / UPEC

SEQ ID NO: 21811 - protein, 236 aa, Escherichia coli O6:H1; identical to SEQ ID NO: 7624
  strain CFT073 / ATCC 700928 / UPEC

SEQ ID NO: 21812 - protein, 883 aa, Escherichia coli O6:H1; identical to SEQ ID NO: 6849
  strain CFT073 / ATCC 700928 / UPEC

SEQ ID NO: 21813 - protein, 551 aa, Escherichia coli O6:H1; identical to SEQ ID NO: 5885
  strain CFT073 / ATCC 700928 / UPEC

SEQ ID NO: 21814 - protein, 207 aa, Escherichia coli O6:H1
  strain CFT073 / ATCC 700928 / UPEC
MPLPDFRFIRLLPLAALVLTACSITTPKGPGKSPDSPQWRQHQQDVRNLNQYQTRGAFAYISDQQKVYARFFWQQTGQDRYRLLLTNPLGSTELELNAQPGNVQLVDNKGQRYTSDDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 21815 - protein, 565 aa, Escherichia coli O6:H1; identical to SEQ ID NO: 6844
  strain CFT073 / ATCC 700928 / UPEC

SEQ ID NO: 21816 - protein, 380 aa, Escherichia coli O6:H1
  strain CFT073 / ATCC 700928 / UPEC
MNIYRAVTSFFNKSSKKGRTMKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTDGQVAYGKSKFNASGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 21817 - protein, 729 aa, Escherichia coli O6:H1; identical to SEQ ID NO: 6821
  strain CFT073 / ATCC 700928 / UPEC

SEQ ID NO: 21818 - protein, 366 aa, Escherichia coli O6:H1; identical to SEQ ID NO: 6820
  strain CFT073 / ATCC 700928 / UPEC

SEQ ID NO: 21819 - protein, 232 aa, Escherichia coli O6:H1; identical to SEQ ID NO: 19098
  strain CFT073 / ATCC 700928 / UPEC

SEQ ID NO: 21820 - protein, 191 aa, Escherichia coli O6:H1; identical to SEQ ID NO: 6818
  strain CFT073 / ATCC 700928 / UPEC

SEQ ID NO: 21821 - protein, 423 aa, Escherichia coli O6:H1; identical to SEQ ID NO: 7643
  strain CFT073 / ATCC 700928 / UPEC

SEQ ID NO: 21822 - protein, 848 aa, Escherichia coli O6:H1
  strain CFT073 / ATCC 700928 / UPEC
MNNNDLFQASRRRFLAQLGGLTVAGMLGTSLLTPRRATAAQAATEAVISKEGILTGSHWGAIRATVKDGRFVAAKPFELDKYPSKMIAGLPDHVHNAARIRYPMVRVDWLRKRHLSDTSQRGDNRFVRVSWDEALDMFYEELERVQKTHGPSALLTASGWQSTGMFHNASGMLAKAIALHGNSVGTGGDYSTGAAQVILPRVVGSMEVYEQQTSWPLVLQNSKTIVLWGSDLLKNQQANWWCPDHDVYEYYEQLKAKVAAGEIEVISIDPVVTSTHEYLGREHVKHIAVNPQTDVPLQLALAHTLYSENLYDKNFLANYCVGFEQFLPYLLGEKDGQPKDAAWAEKLTGIDAETIRGLARQMAANRTQIIAGWCVQRMQHGEQWAWMIVVLAAMLGQIGLPGGGFGFGWHYNGAGTPGRKGVILSGFSGSTSIPPVHDNSDYKGYSSTIPIARFIDAILEPGKVINWNGKSVKLPPLKMCIFAGTNPFHRHQQINRIIEGWRKLETVIAIDNQWTSTCRFADIVLPATTQFERNDLDQYGNHSNRGIIAMKQVVPPQFEARNDFDIFRELCRRFNREEAFTEGLDEMGWLKRIWQEGVQQGKGRGVHLPAFNDFWNNKEYVEFDHPQMFVRHQAFREDPDLEPLGTPSGLIEIYSKTIADMNYDDCQGHPMWFEKIERSHGGPGSQKYPLHLQSVHPDFRLHSQLCESETLRQQYTVAGKEPVFISPKDASARGIRHGDVVRVFNVRGQVLAGAVVSDRYAPGVARIHEGAWYDPDKGGEPGALCKYGNPNVLTIDIGTSQLAQATSAHTTLVEIEKYNGTVEQVTAFNGPVEMVAQCEYVPASQVKS

SEQ ID NO: 21823 - protein, 362 aa, Escherichia coli O6:H1; identical to SEQ ID NO: 5874
  strain CFT073 / ATCC 700928 / UPEC

SEQ ID NO: 21824 - protein, 512 aa, Escherichia coli O6:H1; identical to SEQ ID NO: 7647
  strain CFT073 / ATCC 700928 / UPEC

SEQ ID NO: 21825 - protein, 760 aa, Escherichia coli O6:H1
  strain CFT073 / ATCC 700928 / UPEC
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVVFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDLSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 21826 - protein, 746 aa, Escherichia coli O6:H1; identical to SEQ ID NO: 6783
  strain CFT073 / ATCC 700928 / UPEC

SEQ ID NO: 21827 - protein, 110 aa, Escherichia coli O6:H1
  strain CFT073 / ATCC 700928 / UPEC
MKKALQVAMFSLFTVIGFNAQANEHHHETMSEAQPQVISATGVVKGVDLESKKITIHHDPIAAVNWPEMTMRFTITPQTKMSEIKTGDKVAFNFVQQGNLSLLQDIKVSQ

SEQ ID NO: 21828 - protein, 460 aa, Escherichia coli O6:H1
  strain CFT073 / ATCC 700928 / UPEC
MSPCKLLPFCVALALTGCSLAPDYQRPAMPVPQQFSLSQNGLVNAADNYQNAGWRTFFVDNQVKTLISEALVNNRDLRMAALKVQEARAQYRLTDADRYPQLNGEGSGSWSGNLKGDSATTREFSTGLNASFDLDFFGRLKNMSEAERQNYLATEEAQRAVHILLVSNVAQSYFNQQLAYAQLQIAEETLRNYQQSYAFVEKQLLTGSSNVLALEQARGVIESTRSDIAKRQGELAQANNALQLLLGSYGKLPQAQTVNSDSLQSVKLPAGLPSQILLQRPDIMEAEHALMAANANIGAARAAFFPSISLTSGISTASSDLSSLFNASSGMWNFIPKIEIPIFNAGRNQANLDIAEIRQQQSVVNYEQKIQNAFKEVADALALRQSLNDQISAQQRYLASLQITLQRARTLYQHGAVSYLEVLDAERSLFATRQTLLDLNYARQVNEISLYTALGGGWQQ

SEQ ID NO: 21829 - protein, 353 aa, Escherichia coli O6:H1; identical to SEQ ID NO: 6846
  strain CFT073 / ATCC 700928 / UPEC

SEQ ID NO: 21830 - protein, 1371 aa, Escherichia coli O6:H1
  strain CFT073 / ATCC 700928 / UPEC
MNKVYSLKYCPVTGGLIVVSELASRVIKKTCRRLTHILLAGIPAVYLYYPQISQAGIVRSDIAYQIYRDFAENKGLFVPGATDIPVYDKDGKLVGRLDKAPMADFSSVSSNGVATLVSPQYIVSVKHNGGYQSVSFGNGKNTYSLVDRNNHSSVDFHAPRLNKLVTEVIPSAITSEGTKANAYKDTERYTAFYRVGSGTQYTKDKDGNLVKVAGGYAFKTGGTTGVPLISDATIVSNPGQTYNPVNGPLPDYGAPGDSGSPLFAYDEQQKKWVIVAVLRAYAGINGATNWWNVIPTDYLNQVMQDDFDAPVDFVSGLPPLNWTYDKTSGTGTLSQGSKNWTMHGQKDNDLNAGKNLVFSGQNGAIVLKDSVTQGAGYLEFKDSYTVSAESGKTWTGAGIITDKGTNVTWKVNGVAGDNLHKLGEGTLTINGTGVNPGGLKTGDGTVVLNQQADTAGNVQAFSSVNLASGRPTVVLGDARQVNPDNISWGYRGGKLDLNGNAVTFTRLQAADYGAVITNNAQQKSRLLLDLKAQDTNVSVPIGSISPFGGTGTPGNLYSMILNGQTRFYILKSASYGNTLWGNSLNDPAQWEFVGTDKNKAVQTVKDRILAGRAKQPVIFHGQLTGNMDVTIPQLPGGRKVILDGSVNLPEGTLSEDSGTLIFQGHPVIHASVSGSAPVSLNQKDWENRQFIMKTLSLKDADFHLSRNASLNSDIKSDNSHITLGSDRVFVDKNDGTGNYVILEEGTSVPDTVNDRSQYEGNITLDHNSTLDIGSRFTGGIEAYDSAVSITSPDVLLTAPGAFAGSSLTVHDGGHLTALNGLFSDGHIQAGKNSKITLSGTPVKDTANQYAPAVYLTDGYDLTGDNATLEITRGAHASGDIHASAASTVTIGSDTPAELASAETTASAFAGSLLEGYNAAFNGAITGGRADVSMHNALWTLGGDSAIHTLTVRNSRISSEGDRTFRTLTVNKLDATGSDFVLRTDLKNADKINVTEKATGSDNSLNVSFMKDPAQGQSLNIPLVTAPAGTSAEMFKAGTRMIGFSRVTPTLHVDTSGGNTKWILDGFKAEADKAAAAKADSFMNAGYKNFMTEVNNLNKRMGDLRDTNGDAGAWARIMSGAGSADGGYSDNYTHVQVGFDKKHELDGVDLFTGVTMTYTDSSADSHAFSGKTKSVGGGLYASALFESGAYIDLIGKYIHHDNDYTGNFAGLGTKHYNTHSWYAGAETGYRYHLTEETFIEPQAELVYGAVSGKTFRWKDGDMDLSMKNRDFSPLIGRTGIELGKTFSGKDWSVTARAGTSWQFDLLNNGETVLRDASGEKRIKGEKDSRMLFNVGMNAQIKDNMRFGLEFEKSAFGKYNVDNAVNANFRYMF

SEQ ID NO: 21831 - protein, 266 aa, Escherichia coli O6:H1; identical to SEQ ID NO: 6841
  strain CFT073 / ATCC 700928 / UPEC

SEQ ID NO: 21832 - protein, 752 aa, Escherichia coli O6:H1; identical to SEQ ID NO: 8199
  strain CFT073 / ATCC 700928 / UPEC

SEQ ID NO: 21833 - protein, 246 aa, Escherichia coli O6:H1; identical to SEQ ID NO: 5857
  strain CFT073 / ATCC 700928 / UPEC

SEQ ID NO: 21834 - protein, 862 aa, Escherichia coli O6:H1; identical to SEQ ID NO: 6838
  strain CFT073 / ATCC 700928 / UPEC

SEQ ID NO: 21835 - protein, 784 aa, Escherichia coli O6:H1; identical to SEQ ID NO: 6829
  strain CFT073 / ATCC 700928 / UPEC

SEQ ID NO: 21836 - protein, 725 aa, Escherichia coli O6:H1; identical to SEQ ID NO: 6277
  strain CFT073 / ATCC 700928 / UPEC

SEQ ID NO: 21837 - protein, 843 aa, Escherichia coli O6:H1
  strain CFT073 / ATCC 700928 / UPEC
MNLVMRGMKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDMFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 21838 - protein, 244 aa, Escherichia coli O6:H1; identical to SEQ ID NO: 6219
  strain CFT073 / ATCC 700928 / UPEC

SEQ ID NO: 21839 - protein, 682 aa, Escherichia coli O6:H1; identical to SEQ ID NO: 6220
  strain CFT073 / ATCC 700928 / UPEC

SEQ ID NO: 21840 - protein, 648 aa, Escherichia coli O6:H1
  strain CFT073 / ATCC 700928 / UPEC
MLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 21841 - protein, 678 aa, Escherichia coli O6:H1; identical to SEQ ID NO: 7525
  strain CFT073 / ATCC 700928 / UPEC

SEQ ID NO: 21842 - protein, 713 aa, Escherichia coli O6:H1; identical to SEQ ID NO: 6056
  strain CFT073 / ATCC 700928 / UPEC

SEQ ID NO: 21843 - protein, 759 aa, Escherichia coli O6:H1; identical to SEQ ID NO: 21099
  strain CFT073 / ATCC 700928 / UPEC

SEQ ID NO: 21844 - protein, 1295 aa, Escherichia coli O6:H1
  strain CFT073 / ATCC 700928 / UPEC
MNKIYSLKYSAATGGLIAVSELAKRVSGKTNRKLVATMLSLAVAGTVNAANIDISNVWARDYLDLAQNKGIFQPGATDVTITLKNGDKFSFHNLSIPDFSGAAASGAATAIGGSYSVTVAHNKKNPQAAETQVYAQSSYRVVDRRNSNDFEIQRLNKFVVETVGATPAETNPTTYSDALERYGIVTSDGSKKIIGFRAGSGGTSFINGESKISTNSAYSHDLLSASLFEVTQWDSYGMMIYKNDKTFRNLEIFGDSGSGAYLYDNKLEKWVLVGTTHGIASVNGDQLTWITKYNDKLVSELKDTYSHKINLNGNNVTIKNTDITLHQNNADTTGTQEKITKDKDIVFTNGGDVLFKDNLDFGSGGIIFDEGHEYNINGQGFTFKGAGIDIGKESIVNWNALYSSDDVLHKIGPGTLNVQKKQGANIKIGEGNVILNEEGTFNNIYLASGNGKVILNKDNSLGNDQYAGIFFTKRGGTLDLNGHNQTFTRIAATDDGTTITNSDTTKEAVLAINNEDSYIYHGNINGNIKLTHNINSQDKKTNAKLILDGSVNTKNDVEVSNASLTMQGHATEHAIFRSSANHCSLVFLCGTDWVTVLKETESSYNKKFNSDYKSNNQQTSFDQPDWKTGVFKFDTLHLNNADFSISRNANVEGNISANKSAITIGDKNVYIDNLAGKNITNNGFDFKQTISTNLSIGETKFTGGITAHNSQIAIGDQAVVTLNGATFLDNTPISIDKGAKVIAQNSMFTTKGIDISGELTMMGIPEQNSKTVTPGLHYAADGFRLSGGNANFIARNMASVTGNIYADDAATITLGQPETETPTISSAYQAWAETLLYGFDTAYRGAITAPKATVSMNNAIWHLNSQSSINRLETKDSMVRFTGDNGKFTTLTVNNLTIDDSAFVLRANLAQADQLVVNKSLSGKNNLLLVDFIEKNGNSNGLNIDLVSAPKGTAVDVFKATTRSIGFSDVTPVIEQKNDTDKATWTLIGYKSVANADAAKKATLLMSGGYKAFLAEVNNLNKRMGDLRDINGESGAWARIISGTGSAGGGFSDNYTHVQVGADNKHELDGLDLFTGVTMTYTDSHAGSDAFSGETKSVGAGLYASAMFESGAYIDLIGKYVHHDNEYTATFAGLGTRDYSSHSWYAGAEVGYRYHVTDSAWIEPQAELVYGAVSGKQFSWKDQGMNLTMKDKDFNPLIGRTGVDVGKSFSGKDWKVTARAGLGYQFDLFANGETVLRDASGEKRIKGEKDGRMLMNVGLNAEIRDNLRFGLEFEKSAFGKYNVDNAINANFRYSF

SEQ ID NO: 21845 - protein, 696 aa, Escherichia coli O6:H1; identical to SEQ ID NO: 14793
  strain CFT073 / ATCC 700928 / UPEC

SEQ ID NO: 21846 - protein, 840 aa, Escherichia coli O6:H1
  strain CFT073 / ATCC 700928 / UPEC
MMRGMKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDMFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 21847 - protein, 201 aa, Escherichia coli O6:H1
  strain CFT073 / ATCC 700928 / UPEC
MTLDISNDNKQLPYLAQAWIENENQEKIIAGPVIATPPVQRLEPGAKSMVRLSTTPDISKLPQDRESLFYFNLREIPPRSEKANVLQIALQTKIKLFYRPAAIKTRPNEVWQDQLILNKVSGGYRIENPTPYYVTVIGLGGSEKQAEEGEFETVMLSPRSEQTVKSANYNTPYLSYINDYGGRPVLSFICNGSRCSVKKEK

SEQ ID NO: 21848 - protein, 1024 aa, Escherichia coli O6:H1
  strain CFT073 / ATCC 700928 / UPEC
MPTITTAQIKSTLQSAKQSSANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKRQKSGSNVSSSELAKASIELINQLVDTAASINNNVNSFSQQLNKLGSVLSNTKHLTGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKILQEVVKEQEVSVGKRTEKTQYRSYEFTHINGKNLTETDNLYSVEELIGTTRADKFFGSKFTDIFHGADGDDHIEGNDGNDRLYGDKGNDTLRGGNGDDQLYGGDGNDKLIGGTGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFRREGNDLIMYKAEGNVLSIGHKNGITFRNWFEKESGDISNHQIEQIFDKDGRVITPDSLKKALEYQQSNNKASYVYGNDALAYGSQDNLNPLINEISKIISAAGNFDVKEERAAASLLQLSGNASDFSYGRNSITLTASA

SEQ ID NO: 21849 - protein, 658 aa, Escherichia coli O6:H1; identical to SEQ ID NO: 19652
  strain CFT073 / ATCC 700928 / UPEC

SEQ ID NO: 21850 - protein, 518 aa, Escherichia coli O6:H1; identical to SEQ ID NO: 8246
  strain CFT073 / ATCC 700928 / UPEC

SEQ ID NO: 21851 - protein, 884 aa, Escherichia coli O6:H1; identical to SEQ ID NO: 6149
  strain CFT073 / ATCC 700928 / UPEC

SEQ ID NO: 21852 - protein, 200 aa, Escherichia coli O6:H1; identical to SEQ ID NO: 5898
  strain CFT073 / ATCC 700928 / UPEC

SEQ ID NO: 21853 - protein, 478 aa, Escherichia coli O6:H1
  strain CFT073 / ATCC 700928 / UPEC
MNRDSFYPAIACFPLLLMLAGCAPMHETRQALSQQTPAAQVDTALPTALKNGWPDSQWWLEYHDNQLTSLINNALQSAPDMQVAEQRIQLAEAQAKAVATQDGPQLDFSADMERQKMSAEGLMGPFALNDPAAGTTGPWYTNGTFGLTAGWHLDIWGKNRAEITARLGTVKARAAEREQTRQLLAGSVARLYWEWQTQAALNTVLQQIEKEQNTIIATDRQLYQNGITSSVEGVETDINASKTRQQLNDVAGKMKIIEARLNALTNHQTKSLKLKTVALPKVASQLPDELGYSLLARRADLQAAHWYVESSLSTIDAAKAAFYPDINLMAFLQQDALHLSDLFRHSAQQMGVTAGLTLPIFDSGRLNANLDIAKAESNLSIASYNKAVVEAVNDVARAASQVQTLAEKNQHQAQIERDALRVVGLAQARFNAGLIAGSRVSEARIPALRERANGLLLQGQWLDASIQLTGALGGGYKR

SEQ ID NO: 21854 - protein, 715 aa, Escherichia coli O6:H1; identical to SEQ ID NO: 6806
  strain CFT073 / ATCC 700928 / UPEC

SEQ ID NO: 21855 - protein, 334 aa, Escherichia coli O6:H1; identical to SEQ ID NO: 6798
  strain CFT073 / ATCC 700928 / UPEC

SEQ ID NO: 21856 - protein, 663 aa, Escherichia coli O6:H1
  strain CFT073 / ATCC 700928 / UPEC
MLNGIYSMRLKKRYLCTVLSLAFTQQSVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQNNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYHDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 21857 - protein, 214 aa, Escherichia coli O6:H1; identical to SEQ ID NO: 6822
  strain CFT073 / ATCC 700928 / UPEC

SEQ ID NO: 21858 - protein, 656 aa, Escherichia coli O6:H1; identical to SEQ ID NO: 6178
  strain CFT073 / ATCC 700928 / UPEC

SEQ ID NO: 21859 - protein, 892 aa, Escherichia coli O6:H1; identical to SEQ ID NO: 6811
  strain CFT073 / ATCC 700928 / UPEC

SEQ ID NO: 21860 - protein, 375 aa, Escherichia coli O6:H1
  strain CFT073 / ATCC 700928 / UPEC
MTINFRRNALQLSVAALFSSAFMANAADIPQVKVTVTDKQCEPMIITVNAGKTQFIIQNHSQKALEWEILKGVMVVEERENIAPGFSQKMTANLQPGEYDMTCGLLTNPKGKLIVKGEATADAAQSDALLSLGGAITAYKAYVMAETTQLVTDTKAFTDAIKAGDIEKAKALYAPTRQHYERIEPIAELFSDLDGSIDAREDDYEQKAADPKFTGFHRLEKALFGDNTTKGMDKYADQLYTDVVDLQKRISELAFPPSKVVGGAAGLIEEVAASKISGEEDRYSHTDLWDFQANVEGSQKIVDLLRPQLQKANPELLAKVDANFKKVDTILAKYRTKDGFENYDKLTDADRNALKGPITALAEDLAQLRGVLGLD

SEQ ID NO: 21861 - protein, 332 aa, Escherichia coli O6:H1; identical to SEQ ID NO: 6792
  strain CFT073 / ATCC 700928 / UPEC

SEQ ID NO: 21862 - protein, 186 aa, Escherichia coli O6:H1
  strain CFT073 / ATCC 700928 / UPEC
MNVSKYVAIFFFVFIQLISVGKVFANADEWMTTFRENIAQTWQQPEHYDLYIPAITWHARFAYDKEKTDRYNERPWGGGFGQSRWDEKGNWHGLYAMAFKDSWNKWEPIAGYGWESTWRPLADENFHLGLGFTAGVTARDNWNYIPLPVLLPLASVGYGPATFQMTYIPGTYNNGNVYFAWMRFQF

SEQ ID NO: 21863 - protein, 878 aa, Escherichia coli O6:K15:H31; identical to SEQ ID NO: 14664
  strain 536 / UPEC

SEQ ID NO: 21864 - protein, 218 aa, Escherichia coli O6:K15:H31
  strain 536 / UPEC
MFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESAVKLPSDAGSNITYRTINDYGALTPKMTGVME

SEQ ID NO: 21865 - protein, 368 aa, Escherichia coli O6:K15:H31; identical to SEQ ID NO: 7561
  strain 536 / UPEC

SEQ ID NO: 21866 - protein, 1024 aa, Escherichia coli O6:K15:H31
  strain 536 / UPEC
MPTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGGNVSSSELAKASIELINQLVDTAASLNNNVNSFSQQLNKLGSVLSNTKHLNGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFEILSQYNKEYSVERSVLITQQHWDTLIGELAGVTRNGDKTLSGKSYIDYYEEGKRLEKEPDEFQKQVFDPLKGNIDLSVIKSSTLLKFITPLLTPGKEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGTDLTETDNLYSVEELIGTNRADKFFGSKFTDIFHGADGDDHIEGNDGNDRLYGDKGNDTLRGGNGDDQLYGGDGNDKLTGGVGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFKREGNDLIMYKAEGNVLSIGHKNGITFRNWFEKESGDISNHQIEQIFDKDGRVITPDSLKKAFEYQQSNNQANYVYGEYASTYADLDNLNPLINEISKIISAAGNFDVKEERSAASLLQLSGNASDFSYGRNSITLTASA

SEQ ID NO: 21867 - protein, 840 aa, Escherichia coli O6:K15:H31
  strain 536 / UPEC
MMRVMKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 21868 - protein, 244 aa, Escherichia coli O6:K15:H31; identical to SEQ ID NO: 6111
  strain 536 / UPEC

SEQ ID NO: 21869 - protein, 478 aa, Escherichia coli O6:K15:H31; identical to SEQ ID NO: 6796
  strain 536 / UPEC

SEQ ID NO: 21870 - protein, 237 aa, Escherichia coli O6:K15:H31; identical to SEQ ID NO: 7546
  strain 536 / UPEC

SEQ ID NO: 21871 - protein, 446 aa, Escherichia coli O6:K15:H31; identical to SEQ ID NO: 14690
  strain 536 / UPEC

SEQ ID NO: 21872 - protein, 614 aa, Escherichia coli O6:K15:H31; identical to SEQ ID NO: 16988
  strain 536 / UPEC

SEQ ID NO: 21873 - protein, 208 aa, Escherichia coli O6:K15:H31; identical to SEQ ID NO: 14719
  strain 536 / UPEC

SEQ ID NO: 21874 - protein, 538 aa, Escherichia coli O6:K15:H31
  strain 536 / UPEC
MFRRNIITSAILLMAPLAFSAQSLAESLTVEQRLELLEKALRETQSELKKYKDEEKKKYTPATVNRSVSTNDQGYAANPFPTSHAAKPDAVLVKNEEKNASETGSIYSSMTLKDFSKFVKDEIGFSYNGYYRSGWGTASHGSPKSWAIGSLGRFGNEYSGWFDLQLKQRVYNENGKRVDAIVMMDGNVGQQYSTGWFGDNAGGENFMQFSDMYVTTKGFLPFAPEADFWVGKHGAPKIEIQMLDWKTQRTDAAAGVGLENWKVGPGKIDIALVREDVDDYDRSLQNKQQINTNTIDLRYKDIPLWDKATLMVSGRYVSANESASEKDNQDNNGYYDWKDTWMFGTSLTQKFDKGGFNEFSFLVANNSIASNFGRYAGASPFTTFNGRYYGDHTGGTAVRLTSQGEAYIGDHFIVANAIVYSFGNDIYSYETGAHSDFESIRAVVRPAYIWDQYNQTGVELGYFTQQNKDANSNKYNESGYKTTLFHTFKVNTSMLTSRPEIRFYTTYIKALENELDGFTFEDNKDDQFAVGAQAEIWW

SEQ ID NO: 21875 - protein, 1024 aa, Escherichia coli O6:K15:H31
  strain 536 / UPEC
MPTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGSNVSSSELAKASIELINQLVDTAASINNNVNSFSQQLNKLGSVLSNTKHLNGVGNKLQNLPNLDNIGAGLDTVSGILSVISASFILSNADADTGTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLAAGSANIYAGKGHDVVYYDKTDTGYLTIDGTKATEAGNYTVTRVLGGDVKVLQEVVKEQEVSVGKRTEKTQYRSYEFTHINGTDLTETDNLYSVEELIGTNRADKFFGSKFTDIFHGADGDDHIEGNDGNDRLYGDKGNDTLRGGNGDDQLYGGDGNDKLTGGVGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFKREGNDLIMYKAEGNVLSIGHKNGITFRNWFEKESGDISNHQIEQIFDKDGRVITPDSLKKAFEYQQSNNQANYVYGEYASTYADLDNLNPLINEISKIISAAGNFDVKEERSAASLLQLSGNASDFSYGRNSITLTASA

SEQ ID NO: 21876 - protein, 835 aa, Escherichia coli O6:K15:H31; identical to SEQ ID NO: 6191
  strain 536 / UPEC

SEQ ID NO: 21877 - protein, 233 aa, Escherichia coli O6:K15:H31; identical to SEQ ID NO: 6192
  strain 536 / UPEC

SEQ ID NO: 21878 - protein, 241 aa, Escherichia coli O6:K15:H31; identical to SEQ ID NO: 6193
  strain 536 / UPEC

SEQ ID NO: 21879 - protein, 844 aa, Escherichia coli O6:K15:H31
  strain 536 / UPEC
MNANNLSCLIYCRCSLLLFAALGLTVTNHSFAAEEAEFDSEFLHLDKGINAIDIRRFSHGNPVPEGRYYSDIYVNNVWKGKADLQYLRTANTGAPTLCLTPELLSLIDLVKDTMSGNTSCFPASTGLSSASINFDLSTLRLNIEIPQALLNTRPRGYISPSQWQSGVPAAFINYDANYYQYSSSGTSNEQTYLGLKAGFNLWGWALRHRGSESWNNSYPAGYQNIETSIMHDLAPLRAQFTLGDFYTNGELMDSLSLRGVRLASDERMLPGSLRGYAPAVRGIANSNAKVTIYQNAHILYETTVPAGPFVINDLYPSGYAGDLIVKITESNGQTRMFTVPFAAVAQLIRPGFSRWQMSVGKYRYANKTYNDLIAQGTYQYGLTNDITLNSGLTTASGYTAGLAGLAFNTPLGAIASDITLSRTAFRYSGVTRKGYSLHSSYSINIPASNTNITLAAYRYSSKDFYHLKDALSANHNAFIDDVSVKSTAFYRPRNQFQISINQELGEKWGGMYLTGTTYNYWGHKGSRNEYQMGYSNFWKQLGYQIGLSQSRDNEQQRRDDRFYINFTLPLGESVQSPVFSTVLNYSKEEKNSIQTSISGTGGEDNQFSYGLSGNSQENGPSGYAMNGGYRSPYVNITTTVGHDTQNNNQRSFGASGAVVAHPYGVTLSNDLSDTFAIIHAEGAQGAAINNASGSRLDFWGNGIVPYVTPYEKNQISIDPSNLDLNVELSATEQEIIPRANSATLVKFDTKTGRSLLFDIRMSTGNPPPMASEVLDEHGQLAGYVAQAGKVFTRGLPEKGHLSVVWGPDNKDRCSFVYHVAHNKDDMQSQLVPVLCIQHPNQEKT

SEQ ID NO: 21880 - protein, 660 aa, Escherichia coli O6:K15:H31; identical to SEQ ID NO: 6257
  strain 536 / UPEC

SEQ ID NO: 21881 - protein, 438 aa, Escherichia coli O6:K15:H31; identical to SEQ ID NO: 7593
  strain 536 / UPEC

SEQ ID NO: 21882 - protein, 250 aa, Escherichia coli O6:K15:H31; identical to SEQ ID NO: 14682
  strain 536 / UPEC

SEQ ID NO: 21883 - protein, 259 aa, Escherichia coli O6:K15:H31; identical to SEQ ID NO: 14683
  strain 536 / UPEC

SEQ ID NO: 21884 - protein, 412 aa, Escherichia coli O6:K15:H31; identical to SEQ ID NO: 11006
  strain 536 / UPEC

SEQ ID NO: 21885 - protein, 900 aa, Escherichia coli O6:K15:H31; identical to SEQ ID NO: 5859
  strain 536 / UPEC

SEQ ID NO: 21886 - protein, 654 aa, Escherichia coli O6:K15:H31; identical to SEQ ID NO: 8265
  strain 536 / UPEC

SEQ ID NO: 21887 - protein, 678 aa, Escherichia coli O6:K15:H31; identical to SEQ ID NO: 14695
  strain 536 / UPEC

SEQ ID NO: 21888 - protein, 222 aa, Escherichia coli O6:K15:H31; identical to SEQ ID NO: 8389
  strain 536 / UPEC

SEQ ID NO: 21889 - protein, 713 aa, Escherichia coli O6:K15:H31
  strain 536 / UPEC
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 21890 - protein, 686 aa, Escherichia coli O6:K15:H31; identical to SEQ ID NO: 6339
  strain 536 / UPEC

SEQ ID NO: 21891 - protein, 856 aa, Escherichia coli O6:K15:H31; identical to SEQ ID NO: 6166
  strain 536 / UPEC

SEQ ID NO: 21892 - protein, 290 aa, Escherichia coli O6:K15:H31
  strain 536 / UPEC
MCGGHPGTSGPGTTVAAALSSGEVTLYTPAIVCISRQKNVKKQRAENMQKMKPALKKTLMAVACLSAVPAAQAAVSLDRTRAIFNGDEKSMTLNIANDNKQLPYLAQAWVENEKKEKITTGPIIATPPVQRLEPGSKSMVRLTSTPDISRLPQDRESLFYFSLREIPPKSDKANVLQIALQTKIKLFYRPESIKAKPNAVWQDQLVLNKTSGGYRIDNPTPYYVTVIGIGGSEKQAREGEFDAVMLAPKSTQMVKSGTYNTPYLSYINDYGGRPVLQFSCGGSRCTAVKK

SEQ ID NO: 21893 - protein, 359 aa, Escherichia coli O6:K15:H31; identical to SEQ ID NO: 5847
  strain 536 / UPEC

SEQ ID NO: 21894 - protein, 432 aa, Escherichia coli O6:K15:H31; identical to SEQ ID NO: 5727
  strain 536 / UPEC

SEQ ID NO: 21895 - protein, 518 aa, Escherichia coli O6:K15:H31; identical to SEQ ID NO: 7565
  strain 536 / UPEC

SEQ ID NO: 21896 - protein, 884 aa, Escherichia coli O6:K15:H31
  strain 536 / UPEC
MCMPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKHWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 21897 - protein, 250 aa, Escherichia coli O6:K15:H31; identical to SEQ ID NO: 14717
  strain 536 / UPEC

SEQ ID NO: 21898 - protein, 274 aa, Escherichia coli O6:K15:H31; identical to SEQ ID NO: 14653
  strain 536 / UPEC

SEQ ID NO: 21899 - protein, 200 aa, Escherichia coli O6:K15:H31; identical to SEQ ID NO: 14662
  strain 536 / UPEC

SEQ ID NO: 21900 - protein, 375 aa, Escherichia coli O6:K15:H31
  strain 536 / UPEC
MKVKVLSLLVPALLVAGAANAAEVYNKDGNKLDLYGKVDGLHYFSDDKSVDGDQTYMRLGFKGETQVTDQLTGYGQWEYQIQGNAPESENNSWTRVAFAGLKFQDIGSFDYGRNYGVVYDVTSWTDVLPEFGGDTYGSDNFMQQRGNGFATYRNTDFFGLVDGLNFAVQYQGQNGSVSGENDPDFTGHGITNNGRKALRQNGDGVGGSITYDYEGFGVGAAVSSSKRTDAQNTAAYIGNGDRAETYTGGLKYDANNIYLAAQYTQTYNATRVGSLGWANKAQNFEAVAQYQFDFGLRPSVAYLQSKGKNLGTIGTRNYDDEDILKYVDVGATYYFNKNMSTYVDYKINLLDDNQFTRDAGINTDNIVALGLVYQF

SEQ ID NO: 21901 - protein, 162 aa, Escherichia coli O6:K15:H31; identical to SEQ ID NO: 5896
  strain 536 / UPEC

SEQ ID NO: 21902 - protein, 828 aa, Escherichia coli O6:K15:H31; identical to SEQ ID NO: 5895
  strain 536 / UPEC

SEQ ID NO: 21903 - protein, 663 aa, Escherichia coli O6:K15:H31
  strain 536 / UPEC
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQERDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 21904 - protein, 224 aa, Escherichia coli O6:K15:H31; identical to SEQ ID NO: 5893
  strain 536 / UPEC

SEQ ID NO: 21905 - protein, 826 aa, Escherichia coli O6:K15:H31
  strain 536 / UPEC
MLRMTPLASAIVALLIGIEAYAAEETFDTHFMIGGMKDQQVSNIRLEDNQPLPGQYDIDIYVNKQWRGKYEIIVKDNPQETCLSREMIKRLGINTDNFASGKQCLTFKQLIQGGSYTWDIGVFRLDFSVPQAWVEELESGYVPPENWERGINAFYTSYYVSQYYSDYKASGNSKSTYVRFNSGLNLLGWQLHSDASFSKTNNNPGGWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGHQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSKSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICQ

SEQ ID NO: 21906 - protein, 721 aa, Escherichia coli O6:K15:H31; identical to SEQ ID NO: 6807
  strain 536 / UPEC

SEQ ID NO: 21907 - protein, 715 aa, Escherichia coli O6:K15:H31; identical to SEQ ID NO: 6806
  strain 536 / UPEC

SEQ ID NO: 21908 - protein, 673 aa, Escherichia coli O6:K15:H31; identical to SEQ ID NO: 6170
  strain 536 / UPEC

SEQ ID NO: 21909 - protein, 360 aa, Escherichia coli O6:K15:H31; identical to SEQ ID NO: 5891
  strain 536 / UPEC

SEQ ID NO: 21910 - protein, 118 aa, Escherichia coli O6:K15:H31 [sequence omitted]

SEQ ID NO: 21911 - protein, 102 aa, Escherichia coli O6:K15:H31; identical to SEQ ID NO: 14041
  strain 536 / UPEC

SEQ ID NO: 21912 - protein, 700 aa, Escherichia coli O6:K15:H31; identical to SEQ ID NO: 14710
  strain 536 / UPEC

SEQ ID NO: 21913 - protein, 539 aa, Escherichia coli O6:K15:H31; identical to SEQ ID NO: 7564
  strain 536 / UPEC

SEQ ID NO: 21914 - protein, 207 aa, Escherichia coli O6:K15:H31; identical to SEQ ID NO: 5882
  strain 536 / UPEC

SEQ ID NO: 21915 - protein, 565 aa, Escherichia coli O6:K15:H31; identical to SEQ ID NO: 5881
  strain 536 / UPEC

SEQ ID NO: 21916 - protein, 656 aa, Escherichia coli O6:K15:H31; identical to SEQ ID NO: 14673
  strain 536 / UPEC

SEQ ID NO: 21917 - protein, 203 aa, Escherichia coli O6:K15:H31; identical to SEQ ID NO: 7450
  strain 536 / UPEC

SEQ ID NO: 21918 - protein, 360 aa, Escherichia coli O6:K15:H31; identical to SEQ ID NO: 5879
  strain 536 / UPEC

SEQ ID NO: 21919 - protein, 213 aa, Escherichia coli O6:K15:H31; identical to SEQ ID NO: 5744
  strain 536 / UPEC

SEQ ID NO: 21920 - protein, 659 aa, Escherichia coli O6:K15:H31
  strain 536 / UPEC
MQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQNDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTFKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 21921 - protein, 365 aa, Escherichia coli O6:K15:H31; identical to SEQ ID NO: 19099
  strain 536 / UPEC

SEQ ID NO: 21922 - protein, 235 aa, Escherichia coli O6:K15:H31; identical to SEQ ID NO: 6404
  strain 536 / UPEC

SEQ ID NO: 21923 - protein, 191 aa, Escherichia coli O6:K15:H31; identical to SEQ ID NO: 14698
  strain 536 / UPEC

SEQ ID NO: 21924 - protein, 511 aa, Escherichia coli O6:K15:H31; identical to SEQ ID NO: 5749
  strain 536 / UPEC

SEQ ID NO: 21925 - protein, 423 aa, Escherichia coli O6:K15:H31
  strain 536 / UPEC
MQYEDENGVNEPSRRRLLKGIGALALAGSCPVAHAQKTQSAPGTLSPDARNEKQPFYGEHQAGILTPQQAAMMLVAFDVLASDKADLERLFRLLTQRFAFLTQGGAAPETPNPRLPPLDSGILGGYIAPDNLTITLSVGHSLFDERFGLAPQMPKKLQKMTRFPNDSLDAALCHGDVLLQICANTQDTVIHALRDIIKHTPDLLSVRWKREGFISDHAARSKGKETPINLLGFKDGTANPDSQNAKLMQKVVWVTADQQEPAWTIGGSYQAVRLIQFRVEFWDRTPLKEQQTIFGRDKQTGAPLGMLHEHDVPDYASDPEGKVIALDSHIRLANPRTAESESSLMLRRGYSYSLGVTNSGQLDMGLLFVCYQHDLEKGFLTVQKRLNGEALEEYVKPIGGGYFFALPGVKDANDYLGSALLRV

SEQ ID NO: 21926 - protein, 375 aa, Escherichia coli O6:K15:H31
  strain 536 / UPEC
MTINFRRNALQVSVAALFSSAFMANAADIPQVKVTVTDKQCEPMTITVNAGKTQFIIQNHSQKALEWEILKGVMVVEERENIAPGFSQKMTANLQPGEYDMTCGLLTNPKGKLIVKGEATADAAQSDALLSLGGAITAYKAYVMAETTQLVTDTKAFTDAIKAGDIEKAKALYAPTRQHYERIEPIAELFSDLDGSIDAREDDYEQKAADPKFTGFHRLEKALFGDNTTKGMDKYADQLYTDVVDLQKRISELAFPPSKVVGGAAGLIEEVAASKISGEEDRYSHTDLWDFQANVEGSQKIVDLLRPQLQKANPELLAKVDANFKKVDTILAKYRTKDGFENYDKLTDADRNALKGPITALAEDLAQLRGVLGLD

SEQ ID NO: 21927 - protein, 362 aa, Escherichia coli O6:K15:H31; identical to SEQ ID NO: 5874
  strain 536 / UPEC

SEQ ID NO: 21928 - protein, 204 aa, Escherichia coli O6:K15:H31
  strain 536 / UPEC
MMKKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDAAKFTFTPAQGVTVDDQRK

SEQ ID NO: 21929 - protein, 512 aa, Escherichia coli O6:K15:H31
  strain 536 / UPEC
MARAVHRSGLVALGIATALMASCAFAAKNVVVAVGSNFTTLDPYDANDTLSQAVAKSFYQGLFGLDKEMKLKNVLAESYTVSDDGLTYTVKLREGIKFQDGTDFNAAAVKANLDRASDPANHLKRYNLYKNIAKTEAIDPTTVKITLKQPFSAFINILAHPATAMISPAALEKYGKEIGFHPVGTGPYELDTWNQTDFVKVKKFVGYWQPGLPKLDSITWRPVADNNTRAAMLQTGEAQFAFPIPYEQAALLEKNKNIELMASPSIMQRYISMNVTQKPFDNPKVREALNYAINRPALVKVAFAGYATPATGVVPPSIAYAQSYKPWPYDPVKARELLKKAGYPNGFSTTLWSSHNHSTAQKVLQFTQQQLAQVGIKAQVTAMDAGQRAAEVEGKGQKESGVRMFYTGWSASTGEADWALSPLFASQNWPPTLFNTAFYSNKQVDDFLAQALKTNDPAEKTRLYKAAQDIIWQESPWIPLVVEKLVSAHSKNLTGFWIMPDTGFSFEDADLQ

SEQ ID NO: 21930 - protein, 760 aa, Escherichia coli O6:K15:H31
  strain 536 / UPEC
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATAYGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEDYWVADAKLGYRVNRNLDFQLNVYNLFDTDYVASINKSGYRYHPGEPRTFLLTANMHF

SEQ ID NO: 21931 - protein, 331 aa, Escherichia coli O6:K15:H31; identical to SEQ ID NO: 8190
  strain 536 / UPEC

SEQ ID NO: 21932 - protein, 430 aa, Escherichia coli O6:K15:H31; identical to SEQ ID NO: 5758
  strain 536 / UPEC

SEQ ID NO: 21933 - protein, 193 aa, Escherichia coli O6:K15:H31; identical to SEQ ID NO: 6300
  strain 536 / UPEC

SEQ ID NO: 21934 - protein, 186 aa, Escherichia coli O6:K15:H31
  strain 536 / UPEC
MKVSKYVAIFFFVFIQLISVGKVFANADEWMTTFRENIAQTWQQPEHYDLYIPAITWHARFAYDKEKTDRYNERPWGGGFGQSRWDEKGNWHGLYAMAFKDSWNKWEPIAGYGWESTWRPLADENFHLGLGFTAGVTARDNWNYIPLPVLLPLASVGYGPATFQMTYIPGTYNNGNVYFAWMRFQF

SEQ ID NO: 21935 - protein, 749 aa, Escherichia coli O6:K15:H31; identical to SEQ ID NO: 5867
  strain 536 / UPEC

SEQ ID NO: 21936 - protein, 654 aa, Escherichia coli O6:K15:H31
  strain 536 / UPEC
MNVIRTVICTLIILPVGLQAATSHSSMVKDTITIVATGNQNTVFETPSMVSVVTNDTPWSQNAVTSAGMLKGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGEHAPNKEKPAALFAKGSVGITDSNKAGASLRLYRNNTTEPGNSTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTDNDRLQLKGGYFGTDARNYIATRVDMKRMRSYSYNVSRARIWGWDMQGNYQSDYVDWMLSYNRTESMDASSREWLGSGNPDTLISDISIPVGHRGVYAGWRAELSASATHVKKGDPHQAGYTIHSFSLSYKPVSVKGFEASVTLDNAFNKLAMNGKGVPLSGRTVSLYTRYQW

SEQ ID NO: 21937 - protein, 725 aa, Escherichia coli O6:K15:H31; identical to SEQ ID NO: 6241
  strain 536 / UPEC

SEQ ID NO: 21938 - protein, 876 aa, Escherichia coli O6:K15:H31; identical to SEQ ID NO: 6255
  strain 536 / UPEC

SEQ ID NO: 21939 - protein, 231 aa, Escherichia coli O6:K15:H31; identical to SEQ ID NO: 6256
  strain 536 / UPEC

SEQ ID NO: 21940 - protein, 351 aa, Escherichia coli O6:K15:H31
  strain 536 / UPEC
MKKSTLALVVMGIVASVSVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLNLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLESDNKLNINNDDIVAVGMTYQF

SEQ ID NO: 21941 - protein, 161 aa, Escherichia coli O6:K15:H31; identical to SEQ ID NO: 5769
  strain 536 / UPEC

SEQ ID NO: 21942 - protein, 810 aa, Escherichia coli O6:K15:H31; identical to SEQ ID NO: 6345
  strain 536 / UPEC

SEQ ID NO: 21943 - protein, 747 aa, Escherichia coli O6:K15:H31; identical to SEQ ID NO: 7499
  strain 536 / UPEC

SEQ ID NO: 21944 - protein, 246 aa, Escherichia coli O6:K15:H31; identical to SEQ ID NO: 14706
  strain 536 / UPEC

SEQ ID NO: 21945 - protein, 862 aa, Escherichia coli O6:K15:H31; identical to SEQ ID NO: 5856
  strain 536 / UPEC

SEQ ID NO: 21946 - protein, 170 aa, Escherichia coli O6:K15:H31; identical to SEQ ID NO: 5855
  strain 536 / UPEC

SEQ ID NO: 21947 - protein, 784 aa, Escherichia coli O6:K15:H31; identical to SEQ ID NO: 8272
  strain 536 / UPEC

SEQ ID NO: 21948 - protein, 87 aa, Escherichia coli O63:HNM; identical to SEQ ID NO: 6105

SEQ ID NO: 21949 - protein, 816 aa, Escherichia coli O7:K1
  strain IAI39 / ExPEC
MLRTTRWVAAIIFLYSFPGYAEETFDTHFMIGGMRGEKVSEYRFDNKQPLPGNYELDFYVNHQWRGKKDITIPESPAKPCLPKVLLTTLGVKTDNLNTEDNCILLDEAVHGGQYQWDISEHRLNLTVPQAYINELERGYVPPESWDRGIDVFYTSYNLSQYRSYDSNNNSNTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYTIYQKEVPPGPFTIADLQLSGSGSDLDVSIKEADGSVRSFLVPYSSVPNMLQPGVSNFDFIAGRSQIYGVKNQEDFLEANYIYGLNNLLTLYGGTILSDNYNAITLGNGWNTPLGAISFDATRSSSKLNNDTRHEGTSYQVAYNKYLLQTATHFSVAAWRYASQDYRTFSDHLYENDKINHQSDYDDFYDIGRKNSLSANIMQPLSNNLGNVSLSALWRNYWGRSGNAKDYQFSYSNSWQRISYTFSASQSYDENDKEEERFNLFISIPFHWGDDIAKTRHQINLSNSTSFSKDGYSSNNTGITGIAGEHDQLNYGIYVNQQQQNNDTSLGTNLSWRTPIATIDGSYSHSKNAWQSGGSISSGLVVWPGGINITNQLCDTFAILDAPGLEGAHINGQKYNRTNSKGQVVYDLMIPHRENHLVLDIANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 21950 - protein, 227 aa, Escherichia coli O7:K1
  strain IAI39 / ExPEC
MRIITALLMSFFILPVHAGVVIYGTRIIYPEKSREVLVQLMNQSKNASLIQAWIDDGNTTIAPEKIQVPFILTPPVSRVAGGSGQQLKIRKMPNNLPHNKESLFYLNVLDIPPNNPQNAGKNKIKLALQNRIKLLWRPSGIAPVDKKSFSQLNIKKKNNAISINNETANWITITTIKAQNVKVNNESILLPPFSNNDITLKNNHASEYELTVVDDYGNNIHSNIAAR

SEQ ID NO: 21951 - protein, 784 aa, Escherichia coli O7:K1; identical to SEQ ID NO: 6283
  strain IAI39 / ExPEC

SEQ ID NO: 21952 - protein, 170 aa, Escherichia coli O7:K1
  strain IAI39 / ExPEC
MSGILTRWRQFGKRYFWPHLLLGMVAASLGLPALSNAAEPNAPAKATTRNHEPSAKVNFGQLALLEANTRRPNSNYSVDYWHQHAIRTVIRHLSFAMAPQTLPVAEESLPLQAQHLALLDTLSALLTQEGTPSEKGYHIDYAHFTPQAKFSTPVWISQAQGIRAGPQRLS

SEQ ID NO: 21953 - protein, 366 aa, Escherichia coli O7:K1; identical to SEQ ID NO: 17057
  strain IAI39 / ExPEC

SEQ ID NO: 21954 - protein, 359 aa, Escherichia coli O7:K1
  strain IAI39 / ExPEC
MKKYLALALIAPLLISCSTTKKGDTYNEAWVKDTNGFDILMGQFAHNIENFWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 21955 - protein, 831 aa, Escherichia coli O7:K1
  strain IAI39 / ExPEC
MTIKYTKNYHHLTRIATFCALLYCNSAFSAELVEYDHTFLMGQNASNIDLSRYSEGNPAIPGVYDVSVYVNDQPIINQSITFVAIEGKKNAQACITLKNLLQFHINSPDINNEKAVLLARDEALGNCLNLTEIIPQASVRYDVNDQRLDIDVPQAWVMKNYQNYVDPSLWENGINAAMLSYNLNGYHSETPGRKNDSIYAAFNGGMNLGAWRLRASGNYNWMTDSGGNYDFKNRYIQRDIASLRSQFIIGESYTTGETFDSVSIRGIRLYSDSRMLPPTLASFAPIIHGVANTNAKVTITQGGYKIYETTVPPGAFVIDDLSPSGYGSDLIVTIEESDGSKRTFSQPFSSVVQMLRPGVGRWDISGGQILKDDIQDEPNLFQASYYYGLNNYLTGYTGIQLTDNNYTAGLLGLGLNTSVGAFSFDVTHSNVRIPDDKTYEGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSISAQRSWNEDGDTDDSVYLSFTIPIEKLLGTEQRTSGFQSIDTQLSSDFKGNNQLNVSSSGYSDNARVSYSVNTGYTMNKSSEDLSYVGGYASYESPWGTLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLE

SEQ ID NO: 21956 - protein, 246 aa, Escherichia coli O7:K1
  strain IAI39 / ExPEC
MFFNTKHTTALCFVTCMAFSSSSIADIVISGTRVIYKSDQKSVNVRLENKGNNPLLVQSWLDTGDDNAEPGSITVPFTATPPVSRIDAKRGQTIKLMYTASTSLPKDRESVFWFNVLEVPPKPDAEKVANQSLLQLAFRTRIKLFYRPDGLKGNPSEAPLALKWFWSGSEGKASLRVTNPTPYYVSFSSGDLEASGKRYPIDVKMIAPFSDEVMKVTGLNGKANSAKVHFYAINDFGGAIEGNARL

SEQ ID NO: 21957 - protein, 749 aa, Escherichia coli O7:K1; identical to SEQ ID NO: 21272
  strain IAI39 / ExPEC

SEQ ID NO: 21958 - protein, 266 aa, Escherichia coli O7:K1
  strain IAI39 / ExPEC
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKVSIQNQVLEVCGGENIFKDSRVPWPQVSREQVLARAPQAIVITGGPDQIPKIKQYWGEQLKIPVIPLTSDWFERASPRIILAAQQLCNALSQVD

SEQ ID NO: 21959 - protein, 810 aa, Escherichia coli O7:K1; identical to SEQ ID NO: 6345
  strain IAI39 / ExPEC

SEQ ID NO: 21960 - protein, 161 aa, Escherichia coli O7:K1; identical to SEQ ID NO: 5769
  strain IAI39 / ExPEC

SEQ ID NO: 21961 - protein, 733 aa, Escherichia coli O7:K1; identical to SEQ ID NO: 6078
  strain IAI39 / ExPEC

SEQ ID NO: 21962 - protein, 686 aa, Escherichia coli O7:K1; identical to SEQ ID NO: 6795
  strain IAI39 / ExPEC

SEQ ID NO: 21963 - protein, 249 aa, Escherichia coli O7:K1
  strain IAI39 / ExPEC
MRYLNTKNIIAAGVLLSCMSSIAWGAIIPDRTRIIMNESDKGEALKLTNQSKNLPYLAQTWIEDTKGNKSRDFIVTVPPMVRLNPSEQIQIRMITQEKIAQLPKDRETLFYFNVREIPPKTDKKNVMQVTMQHALKLFWRPKAIELEDDGVMTYEKVEIIRRNDGSIRFNNKMPYHVTLGYIGTNGVTMLPQTQSLMVTPFSHADTQFKNVPSAFQVGYINDFGGLSFYEINCPTVNNSCNVSVAKQGQ

SEQ ID NO: 21964 - protein, 351 aa, Escherichia coli O7:K1
  strain IAI39 / ExPEC
MKKSTLALVVMGIVASASVQAAEIYNKDGNKLDVYGKVKAMHYMSDNDSKDGDQSYIRFGFKGEAQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 21965 - protein, 213 aa, Escherichia coli O7:K1; identical to SEQ ID NO: 5744
  strain IAI39 / ExPEC

SEQ ID NO: 21966 - protein, 678 aa, Escherichia coli O7:K1
  strain IAI39 / ExPEC
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRIWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRETTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 21967 - protein, 331 aa, Escherichia coli O7:K1; identical to SEQ ID NO: 5720
  strain IAI39 / ExPEC

SEQ ID NO: 21968 - protein, 230 aa, Escherichia coli O7:K1
  strain IAI39 / ExPEC
MMTKIKLLMLIIFYLIISTSAHAGGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 21969 - protein, 869 aa, Escherichia coli O7:K1
  strain IAI39 / ExPEC
MKIPTTTDIPQRYTWCLAGICYSSLAILPSFLSYAESYFNPAFLLENGTSVADLSRFERGNHQPAGVYRVDLWRNDEFIGSQDIVFESTTVNTGDKSGGLMPCFNQALLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWSLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGGGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 21970 - protein, 232 aa, Escherichia coli O7:K1
  strain IAI39 / ExPEC
MQKNAAHTYAISSLLVLSLTGCAWIPSTPLVQGATSAQPVPGPAPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 21971 - protein, 191 aa, Escherichia coli O7:K1; identical to SEQ ID NO: 5748
  strain IAI39 / ExPEC

SEQ ID NO: 21972 - protein, 511 aa, Escherichia coli O7:K1; identical to SEQ ID NO: 5749
  strain IAI39 / ExPEC

SEQ ID NO: 21973 - protein, 746 aa, Escherichia coli O7:K1
  strain IAI39 / ExPEC
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMEVTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 21974 - protein, 193 aa, Escherichia coli O7:K1; identical to SEQ ID NO: 6560
  strain IAI39 / ExPEC

SEQ ID NO: 21975 - protein, 236 aa, Escherichia coli O7:K1
  strain IAI39 / ExPEC
MTNTWNRLALLIFAVLSLLVASELQAGVVVGGTRFIFPADRDSISISLTNTSQESWLINSKINRPTRWAGGEASTVPAPLLAAPPLILLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAITPCHVSWRTINDYGGLSAKKEQNLP

SEQ ID NO: 21976 - protein, 866 aa, Escherichia coli O7:K1
  strain IAI39 / ExPEC
MYRTQRQHSLLSSGGVPSFIGGLVVFVSAVFNAQAETWFDPAFFKDDPSMVADLSRFEKGQKITPGVYRVDIVLNQTIVDTRNVNFVEITPEKGIAACLTTESLDAMGVNTDAFPAFKQLDKQACAPLAEIIPDASVTFNVNKLRLEISVPQIAIKSNARGYVPPERWDEGINALLLGYSFSGANSIHSSAGSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQVTIKQNGYTIYQTYVSPGAFEISDLYSTSSSGDLLVEIKEADGSVNSYSVPFSSVPLLQRQGRIKYAVTLAKYRTNSNDQQESKFAQATLQWGGPWGTTWYGGGQYAEYYRTAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPKSNDSYTRKKNYAWMTSNTSIDNEGHSTQNLGLTETLLDDGNLSYSIQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGMPLRFGAMATLDGAQTISGIIDDDGSLYMSGLPAKGTITVRWGDAPDQICHISYELTEQQINAAITRMDSVCE

SEQ ID NO: 21977 - protein, 233 aa, Escherichia coli O7:K1; identical to SEQ ID NO: 8411
  strain IAI39 / ExPEC

SEQ ID NO: 21978 - protein, 357 aa, Escherichia coli O7:K1; identical to SEQ ID NO: 5807
  strain IAI39 / ExPEC

SEQ ID NO: 21979 - protein, 204 aa, Escherichia coli O7:K1; identical to SEQ ID NO: 5755
  strain IAI39 / ExPEC

SEQ ID NO: 21980 - protein, 412 aa, Escherichia coli O7:K1
  strain IAI39 / ExPEC
MKQWIAALLLMLIPGVQAAKPQKVTLMVDDVPVAQVLQALAEQEKLNLVVSPDVSGTVSLHLTDVPWKQALQTVVKSAGLITRQEGNILSVHSVAWQNDNIARQEAEQARAQANLPLENRNITLQYADAGELAKAGEKLLSAKGSMTVDKRTNRLLLRDNKTALSALEQWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 21981 - protein, 430 aa, Escherichia coli O7:K1; identical to SEQ ID NO: 5758
  strain IAI39 / ExPEC

SEQ ID NO: 21982 - protein, 828 aa, Escherichia coli O7:K1
  strain IAI39 / ExPEC
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKMGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 21983 - protein, 162 aa, Escherichia coli O7:K1; identical to SEQ ID NO: 8101
  strain IAI39 / ExPEC

SEQ ID NO: 21984 - protein, 364 aa, Escherichia coli O7:K1; identical to SEQ ID NO: 5776
  strain IAI39 / ExPEC

SEQ ID NO: 21985 - protein, 660 aa, Escherichia coli O7:K1
  strain IAI39 / ExPEC
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLEPALIKRVEIVRGPSALLYGSGALGGVISYDTVDAKDLLREGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSEGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 21986 - protein, 332 aa, Escherichia coli O7:K1; identical to SEQ ID NO: 5757
  strain IAI39 / ExPEC

SEQ ID NO: 21987 - protein, 760 aa, Escherichia coli O7:K1
  strain IAI39 / ExPEC
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNIYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 21988 - protein, 200 aa, Escherichia coli O7:K1
  strain IAI39 / ExPEC
MLAFCRSSLKSKKYFIILLALAAIAGLGTHAAWSSNGLPRIDNKTLARLAQQHPVVVLFRHAERCDRSTNQCLSDKTGITVKGTQDARELGNAFSADIPDFDLYSSNTVRTIQSATWFSAGKKLTVDKRLLQCGNEIYSAIKNLQSKAPDKNIVIFTHNHCLTYIAKDKRDATFKPDYLDGLVMHVEKGKVYLDGEFVNH

SEQ ID NO: 21989 - protein, 274 aa, Escherichia coli O7:K1; identical to SEQ ID NO: 5899
  strain IAI39 / ExPEC

SEQ ID NO: 21990 - protein, 250 aa, Escherichia coli O7:K1; identical to SEQ ID NO: 7479
  strain IAI39 / ExPEC

SEQ ID NO: 21991 - protein, 885 aa, Escherichia coli O7:K1
  strain IAI39 / ExPEC
MCMPNHSNFRLRGIACYIALAISGGSVNAWADDSIQFDPRFLELKGDTKIDLGKFSKKGYVDAGKYNLRVFINKQPLSDEYDINWYVSENDPTKTYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDEDDDSSNSTTSKNWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADEHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQSMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMTVFWEGSAQCEIVLPKPLPADLFSGLLLPCEQKGTAAPDSSAPEIKPVIQDQTRQVTPTEAPTSISATQ

SEQ ID NO: 21992 - protein, 224 aa, Escherichia coli O7:K1; identical to SEQ ID NO: 8426
  strain IAI39 / ExPEC

SEQ ID NO: 21993 - protein, 826 aa, Escherichia coli O7:K1
  strain IAI39 / ExPEC
MLRMTPLASAIVALLLGIEAYAAEETFDTHFMIGGMKDQQVANIRLDDNQPLPGQYDIDIYVNKQWRGKYEIIVKDNPQETCLSREIIKRLGINTDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNSNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIVYNKFVSKTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDMSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICQ

SEQ ID NO: 21994 - protein, 243 aa, Escherichia coli O7:K1; identical to SEQ ID NO: 7472
  strain IAI39 / ExPEC

SEQ ID NO: 21995 - protein, 724 aa, Escherichia coli O7:K1
  strain IAI39 / ExPEC
MYFVLMRDEMLYNIPCRIYILSTLSLCISGIVSTATATSSETKISNEETLVVTTNRSASNLWESPATIQVIDQQTLQNSTNASIADNLQDIPGVEITDNSLAGRKQIRIRGEASSRVLILIDGQEVTYQRAGDNYGVGLLIDESALERVEVVKGPYSVLYGSQAIGGIVNFITKKGGDKLASGVVKAVYNSATAGWEESIAVQGSIGGFDYRINGSYSDQGNRDTPDGRLPNTNYRNNSQGVWLGYNSGNHRFGLSLDRYRLATQTYYEDPDGSYEAFSVKIPKLEREKVGVFYDTDVDGDYLKKIHFDAYEQTIQRQFANEVKTTQPVPSPMIQALTVHNKTDTHDKQYTQAVTLQSHFSLPANNELVTGAQYKQDRVSQRSGGMTSSKSLTGFINKETRTRSYYESEQSTVSLFAQNDWRFADHWTWTMGVRQYWLSSKLTRGDGVSYTAGIISDTSLARESASDHEMVTSTSLRYSGFDNLELRAAFAQGYVFPTLSQLFMQTSAGGSVTYGNPDLKAEHSNNFELGARYNGNQWLIDSAVYYSEAKDYIASLICDGSIVCNGNTNSSRSSYYYYDNIDRAKTWGLEISAEYNGWVFSPYISGNLIRRQYETSTLKTTNTGEPAINGRIGLKHTLVMGQANIISDVFIRAASSAKDDSNGTETNVPGWATLNFAVNTEFGNEDQYRINLALNNLTDKRYRTAHETIPAAGFNAAIGFVWNF

SEQ ID NO: 21996 - protein, 673 aa, Escherichia coli O7:K1
  strain IAI39 / ExPEC
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTSDSELYHGNRVPFVPRYGAGSSVNGVIDTRYGALMPRLAVNLVGPHYFDGDNQLRQGTYATLDSSLGWQATERMNIFVYVDNLFDRRYRTYGYMNGSSAVAQVNMGRTVGINTRIDFF

SEQ ID NO: 21997 - protein, 334 aa, Escherichia coli O7:K1
  strain IAI39 / ExPEC
MKKNQFLKESDVTAESVFFMKRRQVLKALGISAAAFSLPHAAHADLLSWFKGNDRPPAPAGKPLEFSKPAAWQNNLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILDVQRQPTLLFNGYADQVASLYRGLDLRENF

SEQ ID NO: 21998 - protein, 472 aa, Escherichia coli O7:K1
  strain IAI39 / ExPEC
MSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQAYPAVSPTELGKEKFPFLSFLSQSSSNYLTHSPSLLFSRKGSEEKQN

SEQ ID NO: 21999 - protein, 446 aa, Escherichia coli O7:K1; identical to SEQ ID NO: 7485
  strain IAI39 / ExPEC

SEQ ID NO: 22000 - protein, 122 aa, Escherichia coli O7:K1; identical to SEQ ID NO: 5737
  strain IAI39 / ExPEC

SEQ ID NO: 22001 - protein, 237 aa, Escherichia coli O7:K1
  strain IAI39 / ExPEC
MRKITQAISAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAACDVGARGIRILRASNSTYKPLPQAGAFGEEVIVNSEY

SEQ ID NO: 22002 - protein, 478 aa, Escherichia coli O7:K1; identical to SEQ ID NO: 5711
  strain IAI39 / ExPEC

SEQ ID NO: 22003 - protein, 505 aa, Escherichia coli O7:K1
  strain IAI39 / ExPEC
MYKKTTLAMLIALLTGATTVHAQTDISSIESRLAALEQRLKNAESRAQAAEARAKTAELQVQKLAETQQQNQLTTQEVAQRTVQLEQKSAENSGFEFHGYARSGLLMNDAASSSKSGPYLTPAGETGGAVGRLGNEADTYVELNVEHKQTLDNGATTRFKAMLADGQRDYNDWTGGSSNLNIRQAFAELGALPSFTGAFKDSTVWAGKRFDRDNFDIHWLDSDVVFLAGTGGGIYDVKWNDTFRSNFSLYGRNFGDLDDIDNNVQNYILTMNHYAGPFQLMVSGLRAKDNDDRKDANGDLIQTDAANTGVHALVGLHNDTFYGLREGTAKTALLYGHGLGAEVKGIGSDGALLSEANTWRFASYGTTPLGSGWYVAPAILAQSSKDRYVKGDSYEWVTFNTRLIKEVTQNFALAFEGSYQYMDLKPKGYQNHNAVNGSFYKLTFAPTLKANDINNFFSRPELRLFATWMDWSSKLDDFASNDAFGSSGFNTGGEWNFGVQMETWF

SEQ ID NO: 22004 - protein, 843 aa, Escherichia coli O7:K1; identical to SEQ ID NO: 14792
  strain IAI39 / ExPEC

SEQ ID NO: 22005 - protein, 244 aa, Escherichia coli O7:K1; identical to SEQ ID NO: 6219
  strain IAI39 / ExPEC

SEQ ID NO: 22006 - protein, 614 aa, Escherichia coli O7:K1
  strain IAI39 / ExPEC
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLNPEKSKQWEGAFEGLTAGVNWRISGYRNDVSDLIDYDDHTLKYYNEGKARIKGVEATANFDTGPLTHTVSYDYVDARNAITDVPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 22007 - protein, 774 aa, Escherichia coli O7:K1; identical to SEQ ID NO: 7694
  strain IAI39 / ExPEC

SEQ ID NO: 22008 - protein, 368 aa, Escherichia coli O7:K1
  strain IAI39 / ExPEC
MNKTITALAIMMASFATNASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNNSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 22009 - protein, 102 aa, Escherichia coli O7:K1; identical to SEQ ID NO: 14041
  strain IAI39 / ExPEC

SEQ ID NO: 22010 - protein, 203 aa, Escherichia coli O7:K1; identical to SEQ ID NO: 7450
  strain IAI39 / ExPEC

SEQ ID NO: 22011 - protein, 663 aa, Escherichia coli O7:K1
  strain IAI39 / ExPEC
MLNGIYSMRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 22012 - protein, 565 aa, Escherichia coli O7:K1
  strain IAI39 / ExPEC
MKSPTPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSATGTGGGGGEYPLQDGFGWTNGVTLKMLDLICPKEQPCDNVPATRPLSESTTQPLKQKEAEPTP

SEQ ID NO: 22013 - protein, 207 aa, Escherichia coli O7:K1
  strain IAI39 / ExPEC
MPLPDFRLIRLLPLAALVLTACSVTTPKGPGKSPDSPQWRQHQQDVRNLNQYQTRGSFAYISDQQKVYARFFWQQTGQDRYRLLLTNPLGSTELELNAQPGNVQLVDNKGQRYTSDDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 22014 - protein, 208 aa, Escherichia coli O7:K1; identical to SEQ ID NO: 5717
  strain IAI39 / ExPEC

SEQ ID NO: 22015 - protein, 432 aa, Escherichia coli O7:K1; identical to SEQ ID NO: 5727
  strain IAI39 / ExPEC

SEQ ID NO: 22016 - protein, 241 aa, Escherichia coli O7:K1; identical to SEQ ID NO: 6131
  strain IAI39 / ExPEC

SEQ ID NO: 22017 - protein, 878 aa, Escherichia coli O7:K1
  strain IAI39 / ExPEC
MSYLNLRLYQRNTQCLHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 22018 - protein, 203 aa, Escherichia coli O7:K1 str. CE10; identical to SEQ ID NO: 6414

SEQ ID NO: 22019 - protein, 733 aa, Escherichia coli O7:K1 str. CE10; identical to SEQ ID NO: 6078

SEQ ID NO: 22020 - protein, 696 aa, Escherichia coli O7:K1 str. CE10
MRITTLASVVIPCLGFSASSIAAAEDVMIVSASGYEKKLTNAAASVSVISQEELQSSQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWSSGPLVDDSVSLQVRGSTQQRQGSSVTSLSDTAATRIPYPTESQNYNLGARLDWKASAQDVLWFDMDTTRQRYDNRDGQLGSLTGGYDRTLRYERNKISAGYDHTFTFGTWKSYLNWNETENKGRELVRSVLKRDKWGLAGQPRELKESNLILNSLLLTPLGESHLVTVGGEFQSSSMKDGVVLASTGETFRQKSWSVFAEDEWHLTDALALTVGSRYEHHEQFGGHFSPRAYLVWDVADAWTLKGGVTTGYKAPRMGQLHKGISGVSGQGKTNLLGNPDLKPEESVSYEAGVYYDNPAGLNANVTGFMTDFSNKIVSYSINDNTNSYVNSGKARLHGVEFAGILPLWSEDVTLSLNYTWTRSEQRDGDNKGAPLSYTPEHMVNAKLNWQITEEVASWLGARYRGKTPRFTQNYSSLSAVQKKVYDEKGEYLKAWTVVDAGLSWKMTDALTLNAAVNNLLNKDYSDVSLYSAGKSTLYAGDYFQTGSSTTGYVIPERNYWMSLNYQF

SEQ ID NO: 22021 - protein, 686 aa, Escherichia coli O7:K1 str. CE10
MFWRDMTLSVWRKKTTGLKTKKRLLALVLAAALCSSPVWAEEATFTANFKDTDLKSFIETVGANLNKTIIMGLGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLNVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 22022 - protein, 446 aa, Escherichia coli O7:K1 str. CE10; identical to SEQ ID NO: 7485

SEQ ID NO: 22023 - protein, 237 aa, Escherichia coli O7:K1 str. CE10; identical to SEQ ID NO: 22001

SEQ ID NO: 22024 - protein, 478 aa, Escherichia coli O7:K1 str. CE10; identical to SEQ ID NO: 5711

SEQ ID NO: 22025 - protein, 357 aa, Escherichia coli O7:K1 str. CE10; identical to SEQ ID NO: 5807

SEQ ID NO: 22026 - protein, 233 aa, Escherichia coli O7:K1 str. CE10; identical to SEQ ID NO: 8411

SEQ ID NO: 22027 - protein, 866 aa, Escherichia coli O7:K1 str. CE10; identical to SEQ ID NO: 21976

SEQ ID NO: 22028 - protein, 236 aa, Escherichia coli O7:K1 str. CE10; identical to SEQ ID NO: 21975

SEQ ID NO: 22029 - protein, 673 aa, Escherichia coli O7:K1 str. CE10; identical to SEQ ID NO: 21996

SEQ ID NO: 22030 - protein, 715 aa, Escherichia coli O7:K1 str. CE10; identical to SEQ ID NO: 6806

SEQ ID NO: 22031 - protein, 837 aa, Escherichia coli O7:K1 str. CE10
MKQMYKNLKLTTISKMIKNIYCSLSVIVIGCASAYAVEFNKDLIEAEDRENVNLSQFETDGQLPVGKYSLSTLINNKRTPIHLDLQWVLIDNQTAVCVTPEQLTLLGFTDEFIEEAQQNLIDGCYPIEKEKQITTYLDKGRMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPAINAKLTIGQYDTESSIFDSFHFSGISLKSDENMLPPDLRGYAPQITGVAQTNAKVTVSQNNRIIYQENVPPGPFSITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLATGVGFNLNSLGSLSFDVTRSDAQLHNQNKETGYSYRANYSKRFESTGSQLTFAGYRFSDKNFVSMNEYINDTNHYTNYQNEKESYIVTFNQYLESLRLNTYVSLARNTYWDASSNVNYSLSLSRDFDIGPLKNVSTSLTFSRINWEDDNQDQLYLNISIPWGTSRTLSYGMQRNQDNNISHTASWYDSSDRNNSWSVSASGDNDEFKDMEASLRASYQHNTENGRLYLSGTSQRDSYYSLNASWNGSFTATRHGAAFHDYSGSADSRFMIDADGAEDIPLNNKRAVTNRYGIGVIPSVSSYITTSLSVDTRNLPENVDIENSVITTTLTEGAIGYAKLDTRKGYQIIGVIRLPDGSHPPLGISVKDETSHKELGLVADGGFVYLNGIQDDSKLTLRWGDKSCFIQPPKSSNLTTGTVILPCISQN

SEQ ID NO: 22032 - protein, 249 aa, Escherichia coli O7:K1 str. CE10; identical to SEQ ID NO: 21963

SEQ ID NO: 22033 - protein, 843 aa, Escherichia coli O7:K1 str. CE10; identical to SEQ ID NO: 14792

SEQ ID NO: 22034 - protein, 239 aa, Escherichia coli O7:K1 str. CE10
MIRKKILMAAIPLFVISGADAAVSLDRTRAVFDGSEKSMTLDISNDNKQLPYLAQAWIENENQEKIIAGPVIATPPVQRLEPGAKSMVRLSTTPDISKLPQDRESLFYFNLREIPPRSEKANVLQIALQTKIKLFYRPAAIKTRPNEVWQDQLILNKVSGGYRIENPTPYYVTVIGLGGSEKQAEEGEFETVMLSPRSEQTVKSANYNTPYLSYINDYGGRPVLSFICNGSRCSVKKEK

SEQ ID NO: 22035 - protein, 678 aa, Escherichia coli O7:K1 str. CE10; identical to SEQ ID NO: 21966

SEQ ID NO: 22036 - protein, 511 aa, Escherichia coli O7:K1 str. CE10; identical to SEQ ID NO: 5749

SEQ ID NO: 22037 - protein, 191 aa, Escherichia coli O7:K1 str. CE10
MKKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDELDITGDLTLNGVTKPVTLEAKLIGQGDDPWGGKRASFEAEGKIKLKDFNIKTDLGPASQEVDLIISVEGVQQK

SEQ ID NO: 22038 - protein, 232 aa, Escherichia coli O7:K1 str. CE10; identical to SEQ ID NO: 21970

SEQ ID NO: 22039 - protein, 826 aa, Escherichia coli O7:K1 str. CE10; identical to SEQ ID NO: 21993

SEQ ID NO: 22040 - protein, 224 aa, Escherichia coli O7:K1 str. CE10; identical to SEQ ID NO: 8426

SEQ ID NO: 22041 - protein, 407 aa, Escherichia coli O7:K1 str. CE10
MTERELSIIRALGEEFATVLADLQRTFEEKMAAQSGAFEEKLASLSALLQKHVTVDEVRPVLQAMMNDAVGAIPVPRDGRDYDPEVLQQAVNDAVAKIPVPADGKSVTADDVRPMIEQMVKDAVSHIPAPRDGRDYDPEVLQQAVNDAVAKIPVPADGKSVTADDVRPMIEQMVKDAVSHIPAPRDGRDYDPEVLLRAVNDAVGKLPVPADGKSITPDDVRPMLEQMVTDAVSHIPVPRDGRDYDPEVLQKAVLDAVSALPAPQDGRDATALEIFPAIDEQKSFPRGTYATHQGGLWRAYEKTHGMRGWECLVDGVADIDVSMTGERSFTVVVRQSSGQCTEKTFSLPVMLYRGVFRTGETYHPGDTVTWGGSLWHCNSMTGDKPGEAHSSGWTLAAKRGRDAGGGK

SEQ ID NO: 22042 - protein, 774 aa, Escherichia coli O7:K1 str. CE10
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPISLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDHFWGRRKLASLGYQFQPDSQHKFNIQGVYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 22043 - protein, 368 aa, Escherichia coli O7:K1 str. CE10
MNKTITALAIMMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVNKGDKTWLINGEAKPGLRTDAVFELDFTGNNLKWNKLAPVSSPDGVAGGFAGISNNSLIFAGGAGFKGSRENYQNGKNYAHEGLKKSYSTDIHLWHNGKWDKSGELSQGRAYGVSLPWNNSLLIIGGETAGGKAVTDSVLISVKDNKVTVQN

SEQ ID NO: 22044 - protein, 241 aa, Escherichia coli O7:K1 str. CE10; identical to SEQ ID NO: 6131

SEQ ID NO: 22045 - protein, 604 aa, Escherichia coli O7:K1 str. CE10
MLSTQFNRDNQHQAIIKPSLLAGCIALALLPSAAFAAPATEETVIVEGSATAPDNGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMIRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYISSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNW

SEQ ID NO: 22046 - protein, 213 aa, Escherichia coli O7:K1 str. CE10; identical to SEQ ID NO: 5744

SEQ ID NO: 22047 - protein, 380 aa, Escherichia coli O7:K1 str. CE10
MNIYRAVTSFFYNSSKKGRTMKKLTVAISAVAASVLMAMSAQAAEIYNKDSNKLDLYGKVNAKHYFSSNDADDGDTTYARLGFKGETQINDQLTGFGQWEYDFKGNRAESQGSSKDKTRLAFAGLKFGDYGSIDYGRNFGVAYDIGAWTDVLPEFGGDTWTQTDVFMTQRATGVATYRNNDFFGLVDGLNFAAQYQGKNDRTDVAEANGDGFGFSTTYEYEGFGVGATYAKSDRTDGQVAYGKSKFNASGKNAEVWAAGLKYDANNIYLATTYSETQNMTVFGNNHIANKAQNFEAVAQYQFDFGLRPSVAYLQSKGKDLGVHGDRDLVKYVDVGATYYFNKNMSTFVDYKINLIDDSKFTKTAGIDTDDIVAVGLVYQF

SEQ ID NO: 22048 - protein, 878 aa, Escherichia coli O7:K1 str. CE10; identical to SEQ ID NO: 22017

SEQ ID NO: 22049 - protein, 227 aa, Escherichia coli O7:K1 str. CE10; identical to SEQ ID NO: 21950

SEQ ID NO: 22050 - protein, 828 aa, Escherichia coli O7:K1 str. CE10; identical to SEQ ID NO: 21982

SEQ ID NO: 22051 - protein, 162 aa, Escherichia coli O7:K1 str. CE10; identical to SEQ ID NO: 8101

SEQ ID NO: 22052 - protein, 364 aa, Escherichia coli O7:K1 str. CE10; identical to SEQ ID NO: 5776

SEQ ID NO: 22053 - protein, 412 aa, Escherichia coli O7:K1 str. CE10; identical to SEQ ID NO: 21980

SEQ ID NO: 22054 - protein, 784 aa, Escherichia coli O7:K1 str. CE10; identical to SEQ ID NO: 6283

SEQ ID NO: 22055 - protein, 203 aa, Escherichia coli O7:K1 str. CE10; identical to SEQ ID NO: 7450

SEQ ID NO: 22056 - protein, 656 aa, Escherichia coli O7:K1 str. CE10; identical to SEQ ID NO: 8311

SEQ ID NO: 22057 - protein, 565 aa, Escherichia coli O7:K1 str. CE10; identical to SEQ ID NO: 22012

SEQ ID NO: 22058 - protein, 207 aa, Escherichia coli O7:K1 str. CE10; identical to SEQ ID NO: 22013

SEQ ID NO: 22059 - protein, 200 aa, Escherichia coli O7:K1 str. CE10; identical to SEQ ID NO: 21988

SEQ ID NO: 22060 - protein, 274 aa, Escherichia coli O7:K1 str. CE10; identical to SEQ ID NO: 5899

SEQ ID NO: 22061 - protein, 831 aa, Escherichia coli O7:K1 str. CE10; identical to SEQ ID NO: 21955

SEQ ID NO: 22062 - protein, 246 aa, Escherichia coli O7:K1 str. CE10; identical to SEQ ID NO: 21956

SEQ ID NO: 22063 - protein, 749 aa, Escherichia coli O7:K1 str. CE10; identical to SEQ ID NO: 21272

SEQ ID NO: 22064 - protein, 266 aa, Escherichia coli O7:K1 str. CE10; identical to SEQ ID NO: 21958

SEQ ID NO: 22065 - protein, 161 aa, Escherichia coli O7:K1 str. CE10; identical to SEQ ID NO: 5769

SEQ ID NO: 22066 - protein, 250 aa, Escherichia coli O7:K1 str. CE10; identical to SEQ ID NO: 7479

SEQ ID NO: 22067 - protein, 885 aa, Escherichia coli O7:K1 str. CE10; identical to SEQ ID NO: 21991

SEQ ID NO: 22068 - protein, 660 aa, Escherichia coli O7:K1 str. CE10
MSRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSEGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAAKTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 22069 - protein, 351 aa, Escherichia coli O7:K1 str. CE10; identical to SEQ ID NO: 21964

SEQ ID NO: 22070 - protein, 551 aa, Escherichia coli O7:K1 str. CE10
MDRRRFIKGSMAMAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLCMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 22071 - protein, 366 aa, Escherichia coli O7:K1 str. CE10; identical to SEQ ID NO: 17057

SEQ ID NO: 22072 - protein, 518 aa, Escherichia coli O7:K1 str. CE10; identical to SEQ ID NO: 17017

SEQ ID NO: 22073 - protein, 230 aa, Escherichia coli O7:K1 str. CE10; identical to SEQ ID NO: 21968

SEQ ID NO: 22074 - protein, 869 aa, Escherichia coli O7:K1 str. CE10; identical to SEQ ID NO: 21969

SEQ ID NO: 22075 - protein, 243 aa, Escherichia coli O7:K1 str. CE10; identical to SEQ ID NO: 7472

SEQ ID NO: 22076 - protein, 746 aa, Escherichia coli O7:K1 str. CE10; identical to SEQ ID NO: 21973

SEQ ID NO: 22077 - protein, 111 aa, Escherichia coli O7:K1 str. CE10; identical to SEQ ID NO: 5889

SEQ ID NO: 22078 - protein, 505 aa, Escherichia coli O7:K1 str. CE10; identical to SEQ ID NO: 22003

SEQ ID NO: 22079 - protein, 193 aa, Escherichia coli O7:K1 str. CE10; identical to SEQ ID NO: 6560

SEQ ID NO: 22080 - protein, 432 aa, Escherichia coli O7:K1 str. CE10; identical to SEQ ID NO: 5727

SEQ ID NO: 22081 - protein, 208 aa, Escherichia coli O7:K1 str. CE10; identical to SEQ ID NO: 5717

SEQ ID NO: 22082 - protein, 430 aa, Escherichia coli O7:K1 str. CE10; identical to SEQ ID NO: 5758

SEQ ID NO: 22083 - protein, 567 aa, Escherichia coli O7:K1 str. CE10; identical to SEQ ID NO: 17362

SEQ ID NO: 22084 - protein, 614 aa, Escherichia coli O7:K1 str. CE10; identical to SEQ ID NO: 22006

SEQ ID NO: 22085 - protein, 331 aa, Escherichia coli O7:K1 str. CE10; identical to SEQ ID NO: 6551

SEQ ID NO: 22086 - protein, 760 aa, Escherichia coli O7:K1 str. CE10; identical to SEQ ID NO: 21987

SEQ ID NO: 22087 - protein, 118 aa, Escherichia coli O7:K1 str. CE10 [sequence omitted]

SEQ ID NO: 22088 - protein, 359 aa, Escherichia coli O7:K1 str. CE10; identical to SEQ ID NO: 5847

SEQ ID NO: 22089 - protein, 753 aa, Escherichia coli O7:K1 str. CE10; identical to SEQ ID NO: 5801

SEQ ID NO: 22090 - protein, 656 aa, Escherichia coli O7:K1 str. CE10
MYMNVIRNVICTLIILPIGLQAETSHSSMAKDTITVVATGNQNTVFETPSMVSVVTNDTPWSQNAVTSAGMLKGVAGLSQTGAGRTNGQTFNLRGYDKSGVLVLVDGIRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGERAPNKEKPAALFAKGSVGITDSNKAGASLRLYRNNTTEPGNPTQTHGDSGLRDRKTVQNGVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTGNDRLQLKGGYFGTDARNYIATRVDMKRMRSYSYNVSRARIWGWDMQGNYQSDYFDWMLSYNRTESMDASSREWLGSGNPDTLISDISIPVGHGGVSAGWRAELSAAATHVKKGDPHQAGYAVHSFSLSYKPVSVKGFEASVTLDNAFNKLAMNGKGVPLSGRTVSLYTRYQW

SEQ ID NO: 22091 - protein, 124 aa, Escherichia coli O78:H11; identical to SEQ ID NO: 6245
  strain H10407 / ETEC

SEQ ID NO: 22092 - protein, 72 aa, Escherichia coli O78:H11; identical to SEQ ID NO: 5952
  strain H10407 / ETEC

SEQ ID NO: 22093 - protein, 121 aa, Escherichia coli O78:H11; identical to SEQ ID NO: 7723
  strain H10407 / ETEC

SEQ ID NO: 22094 - protein, 208 aa, Escherichia coli O78:H11; identical to SEQ ID NO: 14377
  strain H10407 / ETEC

SEQ ID NO: 22095 - protein, 334 aa, Escherichia coli O78:H11
  strain H10407 / ETEC
MKKNQFLKESDVTAESVFFMKRRQVLKALGISAAALSLPHAAHADLLSWFKGNDRPPAPAGKALEFSKPAAWQNNLPLTPADKVSGYNNFYEFGLDKADPAANAGSLKTDPWTLKISGEVAKPLTLDHDDLTRRFPLEERIYRMRCVEAWSMVVPWIGSPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILDVQRQPTLLFNGYADQVASLYRGLDLRENF

SEQ ID NO: 22096 - protein, 673 aa, Escherichia coli O78:H11
  strain H10407 / ETEC
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADITLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 22097 - protein, 614 aa, Escherichia coli O78:H11
  strain H10407 / ETEC
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTRLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFEKDYETVYGYQTAGREYTLSGSYTF

SEQ ID NO: 22098 - protein, 446 aa, Escherichia coli O78:H11; identical to SEQ ID NO: 6459
  strain H10407 / ETEC

SEQ ID NO: 22099 - protein, 237 aa, Escherichia coli O78:H11; identical to SEQ ID NO: 6675
  strain H10407 / ETEC

SEQ ID NO: 22100 - protein, 784 aa, Escherichia coli O78:H11; identical to SEQ ID NO: 6283
  strain H10407 / ETEC

SEQ ID NO: 22101 - protein, 170 aa, Escherichia coli O78:H11
  strain H10407 / ETEC
MSGILTRWRQFGKRYFWPHLLLGMVAASLGLPALSNAAEPNAPAKATTRNHESSAKVNFGQLALLEANTRRPNSNYSVDYWHQHAIRTVIRHLSFAMAPQTLPVAEESLPLQAQHLALLDTLSALLTQEGTPSEKGYRIDYAHFTPQAKFSTPVWISQAQGIRAGPQRLT

SEQ ID NO: 22102 - protein, 865 aa, Escherichia coli O78:H11
  strain H10407 / ETEC
MTIEYTKNYHHLTRIATFCALLYCNTAFSAELVEYDHTFLMGQNASNIDLSRYSEGNPAIPGVYDVSVYVNDQPIINQSITFVAIEGKKNAQACITLKNLLQFHINSPDINNEKAVLLARDETLGNCLNLTEIIPQASVRYDVNDQRLDIDVPQAWVMKNYQNYVDPSLWENGINAAMLSYNLNGYHSETPGRKNESIYAAFNGGMNLGAWRLRASGNYNWMTDSGSNYDFKNRYVQRDIASLRSQLILGESYTTGETFDSVSIRGIRLYSDSRMLPPTLASFAPIIHGVANTNAKVTITQGGYKIYETTVPPGAFVIDDLSPSGYGSDLIVTIEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNCSRMKNQVTVSINQPLKFEKKDYGSFYLSGSWSDYWASGQNRSNYSIGYSNSTSWGSYSVSAQRSWNEDGDTDDSVYLSFTIPIEKLLGTEQRTSGFQSIDTQISSDFKGNNQLNVSSSGYSDNARVSYSVNTGYTMNKASKDLSYVGGYASYESPWGTLAGSISANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEQSKPVSCLAHYQQSPEAEKIAQSIILNGIRCQIQ

SEQ ID NO: 22103 - protein, 246 aa, Escherichia coli O78:H11; identical to SEQ ID NO: 6964
  strain H10407 / ETEC

SEQ ID NO: 22104 - protein, 747 aa, Escherichia coli O78:H11; identical to SEQ ID NO: 6343
  strain H10407 / ETEC

SEQ ID NO: 22105 - protein, 266 aa, Escherichia coli O78:H11; identical to SEQ ID NO: 5772
  strain H10407 / ETEC

SEQ ID NO: 22106 - protein, 826 aa, Escherichia coli O78:H11
  strain H10407 / ETEC
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVSPGPFAITDLQLAGGGADLDVSVKEADGSVTTYLVPYAAVPNMLQPGVSKYDLAAGRSHIEGASKQSDFVQAGYQYGFNNLLTLYGGSMVANNYYAFTLGAGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQSLTFGYEVNDIHGHNIGVVGQGSQLFIRTNEVPPSVNVAIDKQQGLSCTITFGKEIDESRNYICQ

SEQ ID NO: 22107 - protein, 239 aa, Escherichia coli O78:H11; identical to SEQ ID NO: 6428
  strain H10407 / ETEC

SEQ ID NO: 22108 - protein, 663 aa, Escherichia coli O78:H11; identical to SEQ ID NO: 6307
  strain H10407 / ETEC

SEQ ID NO: 22109 - protein, 478 aa, Escherichia coli O78:H11; identical to SEQ ID NO: 5711
  strain H10407 / ETEC

SEQ ID NO: 22110 - protein, 161 aa, Escherichia coli O78:H11; identical to SEQ ID NO: 5769
  strain H10407 / ETEC

SEQ ID NO: 22111 - protein, 351 aa, Escherichia coli O78:H11; identical to SEQ ID NO: 6367
  strain H10407 / ETEC

SEQ ID NO: 22112 - protein, 828 aa, Escherichia coli O78:H11
  strain H10407 / ETEC
MKLSRRSFMKANAVAAAAAAAGLSVPGVARAVVGQQEAIKWDKAPCRFCGTGCGVLVGTQQGRMVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEDLLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 22113 - protein, 162 aa, Escherichia coli O78:H11; identical to SEQ ID NO: 6365
  strain H10407 / ETEC

SEQ ID NO: 22114 - protein, 367 aa, Escherichia coli O78:H11; identical to SEQ ID NO: 5789
  strain H10407 / ETEC

SEQ ID NO: 22115 - protein, 200 aa, Escherichia coli O78:H11; identical to SEQ ID NO: 6363
  strain H10407 / ETEC

SEQ ID NO: 22116 - protein, 368 aa, Escherichia coli O78:H11; identical to SEQ ID NO: 7728
  strain H10407 / ETEC

SEQ ID NO: 22117 - protein, 241 aa, Escherichia coli O78:H11; identical to SEQ ID NO: 6136
  strain H10407 / ETEC

SEQ ID NO: 22118 - protein, 878 aa, Escherichia coli O78:H11; identical to SEQ ID NO: 19225
  strain H10407 / ETEC

SEQ ID NO: 22119 - protein, 274 aa, Escherichia coli O78:H11; identical to SEQ ID NO: 6362
  strain H10407 / ETEC

SEQ ID NO: 22120 - protein, 250 aa, Escherichia coli O78:H11
  strain H10407 / ETEC
MSDLLCSAKLGAMRLALLLSATSLSALASVTPDRTRLIFNESDKSISVTLRNNDPKLPYLAQSWIEDEKGNKITSPLTVLPPVQRIDSMMNGQVKVQGMPDINKLPADRESMFYFNVREIPPKSNKPNTLQIALQTRIKLFWRPKALEKVSMKSPWQHKVTLTRSGQAFTVNNPTPYYVIISNASAQKNGNPAAGFSPLVIEPKTTVPLNVKMDSVPVLTYVNDFGARMPLFFQCNGNSCQVDEEQSRKG

SEQ ID NO: 22121 - protein, 881 aa, Escherichia coli O78:H11
  strain H10407 / ETEC
MPDHSLFRLRILPWCIALAMSGSYSSVWAEDDIQFDSRFLELKGDTKIDLKRFSSQGYVEPGKYNLQVQLNKQPLAEEYDIYWYAGEDDVSKSYACLTPELVAQFGLKEDVAKNLQWSHDGKCLKPGQLEGMEIKADLSQSALVISLPQAYLEYTWPDWDPPSRWDDGISGIIADYSITAQTRHEENGGDDSNEISGNGTVGVNLGPWRMRADWQTNYQHTRSNDDDDEFGGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGGFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENLMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNIGTSDKHTSVDGYYSHDGSLAQVDLSANYHEGQYTSAGLSLQGGATLTTHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGSVYLAGVKPGEHMSVFWSGVAHCDINLPDPLPADLFNGLLLPCQHKGNVAPVVPDDIKPVIQEQTQQVTPTDPPVSVSANQ

SEQ ID NO: 22122 - protein, 472 aa, Escherichia coli O78:H11; identical to SEQ ID NO: 5729
  strain H10407 / ETEC

SEQ ID NO: 22123 - protein, 230 aa, Escherichia coli O78:H11
  strain H10407 / ETEC
MMTKIKLLMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGNLKFQTVNDYGSVTPVREVNLN

SEQ ID NO: 22124 - protein, 746 aa, Escherichia coli O78:H11; identical to SEQ ID NO: 6710
  strain H10407 / ETEC

SEQ ID NO: 22125 - protein, 193 aa, Escherichia coli O78:H11; identical to SEQ ID NO: 6300
  strain H10407 / ETEC

SEQ ID NO: 22126 - protein, 242 aa, Escherichia coli O78:H11; identical to SEQ ID NO: 6420
  strain H10407 / ETEC

SEQ ID NO: 22127 - protein, 815 aa, Escherichia coli O78:H11
  strain H10407 / ETEC
MNIYRLSFVSCLVMAMPCALAVEFNLNVLDKSMRDRIDISLLKEKGVIAPGEYFVSVAVNNNQISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASNYRPQDGSSSTNLNAYGTTGINAGSWRLRSDYQLNNTDSEDSHEQSGGISRTYLFRPLPQLGSKLTLGETDFSSNIFDGFSYTGAALASDERMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTRWNADASTTANITAGFNVDIGDWRDISISTSFNTTHYEDKDRDNQIYLSISLPFGNGGRVGYDMQNSSHSTIHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQYPPLGADIRQDDSGISVGMVGEEGHAWLSGVAENQLFTVVWGEQSCIIHLPERLEDTTKRLILPCH

SEQ ID NO: 22128 - protein, 430 aa, Escherichia coli O78:H11; identical to SEQ ID NO: 5758
  strain H10407 / ETEC

SEQ ID NO: 22129 - protein, 365 aa, Escherichia coli O78:H11; identical to SEQ ID NO: 7178
  strain H10407 / ETEC

SEQ ID NO: 22130 - protein, 432 aa, Escherichia coli O78:H11; identical to SEQ ID NO: 5727
  strain H10407 / ETEC

SEQ ID NO: 22131 - protein, 332 aa, Escherichia coli O78:H11; identical to SEQ ID NO: 5757
  strain H10407 / ETEC

SEQ ID NO: 22132 - protein, 760 aa, Escherichia coli O78:H11; identical to SEQ ID NO: 6415
  strain H10407 / ETEC

SEQ ID NO: 22133 - protein, 359 aa, Escherichia coli O78:H11
  strain H10407 / ETEC
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRREGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 22134 - protein, 774 aa, Escherichia coli O78:H11
  strain H10407 / ETEC
MTPLRVFRKTTPLVNAIRLSLLPLAGLSFSAFAAQVNIAPGSLDKALNQYAAHSGITLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRSYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYGSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYNDNNKGIYAGQPRTLYMQGSLKF

SEQ ID NO: 22135 - protein, 204 aa, Escherichia coli O78:H11; identical to SEQ ID NO: 5755
  strain H10407 / ETEC

SEQ ID NO: 22136 - protein, 362 aa, Escherichia coli O78:H11; identical to SEQ ID NO: 5809
  strain H10407 / ETEC

SEQ ID NO: 22137 - protein, 233 aa, Escherichia coli O78:H11
  strain H10407 / ETEC
MKTCITKGIVTVSLTAILLSCSSAWAAGKGGIGLAATRLVYSEGEEQISLGVRNTCPDVPYLIQSWVMTPDNKKSADFIITPPLFVLNPANENLLRIMYIGAPLAKDRETLFFTSVRAVPSTTKRKEGNTLKIATQSVIKLFWRPKGLAYPLGEAPAKLRCTSSADMVTVSNPTPYFITLTDLKIGGKVVKNQMISPFDKYQFSLPKGAKNSSVTYRTINDYGAETPQLNCKS

SEQ ID NO: 22138 - protein, 866 aa, Escherichia coli O78:H11
  strain H10407 / ETEC
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYKTNSNEQQVSKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGVQANSGIIDDDGSLYMAGLPAKGTISVRWGEAPDQICHINYELTEQQINSAITRMDAICR

SEQ ID NO: 22139 - protein, 236 aa, Escherichia coli O78:H11; identical to SEQ ID NO: 6409
  strain H10407 / ETEC

SEQ ID NO: 22140 - protein, 686 aa, Escherichia coli O78:H11; identical to SEQ ID NO: 6453
  strain H10407 / ETEC

SEQ ID NO: 22141 - protein, 834 aa, Escherichia coli O78:H11
  strain H10407 / ETEC
MYKKLKLTTISELIKNIYCSLSVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYISLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 22142 - protein, 511 aa, Escherichia coli O78:H11; identical to SEQ ID NO: 6694
  strain H10407 / ETEC

SEQ ID NO: 22143 - protein, 191 aa, Escherichia coli O78:H11; identical to SEQ ID NO: 5748
  strain H10407 / ETEC

SEQ ID NO: 22144 - protein, 232 aa, Escherichia coli O78:H11; identical to SEQ ID NO: 5747
  strain H10407 / ETEC

SEQ ID NO: 22145 - protein, 365 aa, Escherichia coli O78:H11; identical to SEQ ID NO: 6335
  strain H10407 / ETEC

SEQ ID NO: 22146 - protein, 729 aa, Escherichia coli O78:H11; identical to SEQ ID NO: 6402
  strain H10407 / ETEC

SEQ ID NO: 22147 - protein, 213 aa, Escherichia coli O78:H11; identical to SEQ ID NO: 5744
  strain H10407 / ETEC

SEQ ID NO: 22148 - protein, 249 aa, Escherichia coli O78:H11; identical to SEQ ID NO: 6407
  strain H10407 / ETEC

SEQ ID NO: 22149 - protein, 231 aa, Escherichia coli O78:H11; identical to SEQ ID NO: 6400
  strain H10407 / ETEC

SEQ ID NO: 22150 - protein, 838 aa, Escherichia coli O78:H11; identical to SEQ ID NO: 6399
  strain H10407 / ETEC

SEQ ID NO: 22151 - protein, 678 aa, Escherichia coli O78:H11; identical to SEQ ID NO: 14356
  strain H10407 / ETEC

SEQ ID NO: 22152 - protein, 565 aa, Escherichia coli O78:H11; identical to SEQ ID NO: 6395
  strain H10407 / ETEC

SEQ ID NO: 22153 - protein, 207 aa, Escherichia coli O78:H11; identical to SEQ ID NO: 5743
  strain H10407 / ETEC

SEQ ID NO: 22154 - protein, 650 aa, Escherichia coli O78:H11; identical to SEQ ID NO: 6393
  strain H10407 / ETEC

SEQ ID NO: 22155 - protein, 897 aa, Escherichia coli O78:H11; identical to SEQ ID NO: 6392
  strain H10407 / ETEC

SEQ ID NO: 22156 - protein, 412 aa, Escherichia coli O78:H11
  strain H10407 / ETEC
MKQWIAALLLMLIPGVQAAKPQKVTLMVDDVPVAQVLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPLFGQLFRHDGKEDERRELVVFNTPRLVSSE

SEQ ID NO: 22157 - protein, 541 aa, Escherichia coli O78:H11; identical to SEQ ID NO: 6286
  strain H10407 / ETEC

SEQ ID NO: 22158 - protein, 700 aa, Escherichia coli O78:H11; identical to SEQ ID NO: 6388
  strain H10407 / ETEC

SEQ ID NO: 22159 - protein, 102 aa, Escherichia coli O78:H11; identical to SEQ ID NO: 6385
  strain H10407 / ETEC

SEQ ID NO: 22160 - protein, 122 aa, Escherichia coli O78:H11; identical to SEQ ID NO: 5737
  strain H10407 / ETEC

SEQ ID NO: 22161 - protein, 72 aa, Escherichia coli O78:H11; identical to SEQ ID NO: 6077
  strain H10407 / ETEC

SEQ ID NO: 22162 - protein, 258 aa, Escherichia coli O78:H11
  strain H10407 / ETEC
MKNITFIFFILLASPLYANGDKLYRADSRPPDEIKRSGGLMPRGHNEYFDRGTQMNINLYDHARGTQTGFVRYDDGYVSTSLSLRSAHLAGQSILSGYSTYYIYVIATAPNMFNVNDVLGVYSPHPYEQEVSALGGIPYSQIYGWYRVNFGVIDERLHRNREYRDRYYRNLNIAPAEDGYRLAGFPPDHQAWREEPWIHHAPQGCGNSSRTITGDTCNEETQNLSTIYLRKYQSKVKRQIFSDYQSEVDIYNRIRNEL

SEQ ID NO: 22163 - protein, 1364 aa, Escherichia coli O78:H11
  strain H10407 / ETEC
MNKVFSLKYSFLAKGFIAVSELARRVSVKGKLKSASSIIISPITIAIVSYAPPSLAATVNADISYQTFRDFAENKGAFIVGASNINIYDKNGVLVGVLDKAPMPDFSSATMNTGTLPPGDHTLYSPQYVVTAKHVNGSDIMSFGHIQNNYTVVGENNHNSLDIKIRRLNKIVTEVAPAEISSVGAVNGAYQEGGRFKAFYRLGGGLQYIKDKNGNLTPVYTNGGFLTGGTISALSSYNNGQMITAPTGDIFNPANGPLANYLNKGDSGSPLFAYDSLDKKWVLVGVLSSGSEHGNNWVVTTQDFLHQQPKHDFDKTISYDSEKGSLQWRYNKNSGVGTLSQESVVWDMHGKKGGDLNAGKNLQFTGNNGEIILHDSIDQGAGYLQFFDNYTVTSLTDQTWTGGGIITEKGVNVLWQVNGVNDDNLHKVGEGTLTVNGKGVNNGGLKVGDGTVILNQRPDDNGHKQAFSSINISSGRATVILSDANQVNPDKISWGYRGGTLDLNGNNVNFTRLQAADYGAIVSNNNKNKSELTLKLQTLNENDISVDVKTYEVFGGHGSPGDLYYVPASNTYFILKSKAYGPFFSDLDNTNVWQNVGHDRDKAIQIVKQQKIGESSQPYMFHGQLNGYMDVNIHPLSGKDVLTLDGSVNLPEGVITKKSGTLIFQGHPVIHAGMTTSAGQSDWENRQFTMDKLRLDAATFHLSRNAHMQGDISAANGSTVILGSSRVFTDKNDGTGNAVSSVEGSSIATTAGDQSYYSGNVLLENHSSLEVRENFTGGIEAYDSSVSVTSQNAIFDHVGSFVNSSLLLEKGAKLTAQSGIFTNNTMKIKENASLTLTGIPSVGKPGYYSPVTSTTEGIHLGERASLSVKNMGYLSSNITAENSAAIINLGDSNATIGKTDSPLFSTLMRGYNAVLQGNIMGPQSSVNMNNALWHSDRNSELKELKANDSQIELGVRGHFAKLRVKELIASNSVFLVHANNSQADQLNVTDKLQGSNNTILVDFFNKAANGTNVTLITAPKGSDENTFKAGTQQIGFSNITPEIRTENTDTATQWVLTGYQSVADARASKIATDFMDSGYKSFLTEVNNLNKRMGDLRDSQGDAGGWARIMNGTGSGESGYRDNYTHVQIGADRKHELNGIDLFTGALLTYTDNNASSQAFSGKTKSLGGGVYASGLFESGAYFDLIGKYLHHDNRYTLNFASLGERSYTSHSLYAGAEIGYRYHMSENTWVEPQMELVYGSVSGKSFNWKDQGMQLSMKDKDYHPLIGRTGVDVGRAFSGDTWKVTVRAGLGYQFDLLANGETVLQDASGKKHFKGEKDSRMLMNVGTNVEVKDNMRFGLELEKSAFGRYNIDNSINANFRYYF

SEQ ID NO: 22164 - protein, 989 aa, Escherichia coli O78:H11
  strain H10407 / ETEC
MNKVYNTVWNESTGTWVVTSELTRKGGLRPRQIKRTVLAGLIAGLLMPSMPALAAAYDNQTIGRGETSKSMHLSAGDTAKNTTINSGGKQYVSSGGSATSTTINIGGVQHVSSGGSATSSTINSGGHQHVSSGGSATNTTVNNGGRQTVFSGGSAMGTIINSGGDQYVISGGSATSASVTSGARQFVSSGGIVKATSVNSGGRQYVRDGGSATDTVLNNTGRQFVSSGGSAAKTTINSGGGMYLYGGSATGTSIYNGGRQYVSSGGSATNTTVYSGGRQHVYIDGNVTETTITSGGMLQVEAGGSASKVIQNSGGAVITNTSAAVSGTNDNGSFSIAGGSAVNMLLENGGYLTVFDGHQASDTMVGSDGTLDVRSGGVLYGTTTLTDKGALVGDVVTNEGNLYYLNNSTATFTGTLTGTGTLTQEGGNTRFSGLLSQDGGIFLQSGGAMTMDALQAKANVTTQSGTTLTLDNGTILTGNVAGDSTGAGDMAVKGASVWHLDGDSTVGALTLDNGTVDFRPSTTTRMTPAFQAVSLALGSLSGSGTFQMNTDIASHTGDMLNVAGNASGNFVLDIKNTGLEPVSAGAPLQVVQTGGGDAAFTLKGGKVDAGTWEYGLSKENTNWYLKADTPPPVTPPTNPDADNPDAGNPDAGNPDAGNPDAGNPDAGKPGTGKPDAGTSSSPVRRTTKSVDAVLGMATAPAYVFNSELDNLRFRHGDVMQNTRAPGGVWGRYTGSDNRISGGASSGYTLTQNGFETGADMVFDLSDSSLAVGTFFSYSDNSIKHARGGKSNVDSSGGGLYATWFDNDGYYVDGVLKYNRFNNELRTWMSDGTAVKGDYSQNGFGGSLEAGRTFSLNENAWAQPYVRTTAFRADKKEIRLNNGMKASIGATKSLQAEAGLKLGMTLDVAGKEVKPYLSAAVSHEFSDNNKVRINDTYDFRNDISGTTGKYGLGVNAQLTPNAGVWAEARYENGKQTESPITGGVGFRINF

SEQ ID NO: 22165 - protein, 729 aa, Escherichia coli O8; identical to SEQ ID NO: 7401
  strain IAI1

SEQ ID NO: 22166 - protein, 213 aa, Escherichia coli O8; identical to SEQ ID NO: 5744
  strain IAI1

SEQ ID NO: 22167 - protein, 203 aa, Escherichia coli O8; identical to SEQ ID NO: 6347
  strain IAI1

SEQ ID NO: 22168 - protein, 565 aa, Escherichia coli O8
  strain IAI1
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNQHQLNTLRTTSIVPVDLNSLMFKMEKILARASKAAGDNAMANQYETLANARQKGIEKYMWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 22169 - protein, 207 aa, Escherichia coli O8; identical to SEQ ID NO: 5743
  strain IAI1

SEQ ID NO: 22170 - protein, 432 aa, Escherichia coli O8; identical to SEQ ID NO: 5727
  strain IAI1

SEQ ID NO: 22171 - protein, 541 aa, Escherichia coli O8; identical to SEQ ID NO: 6286
  strain IAI1

SEQ ID NO: 22172 - protein, 359 aa, Escherichia coli O8
  strain IAI1
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLQSRNNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 22173 - protein, 686 aa, Escherichia coli O8; identical to SEQ ID NO: 6339
  strain IAI1

SEQ ID NO: 22174 - protein, 700 aa, Escherichia coli O8; identical to SEQ ID NO: 7945
  strain IAI1

SEQ ID NO: 22175 - protein, 883 aa, Escherichia coli O8
  strain IAI1
MTAFRAAFKAYRMHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKIALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYYSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITASLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 22176 - protein, 239 aa, Escherichia coli O8; identical to SEQ ID NO: 6291
  strain IAI1

SEQ ID NO: 22177 - protein, 837 aa, Escherichia coli O8; identical to SEQ ID NO: 15471
  strain IAI1

SEQ ID NO: 22178 - protein, 249 aa, Escherichia coli O8; identical to SEQ ID NO: 6450
  strain IAI1

SEQ ID NO: 22179 - protein, 102 aa, Escherichia coli O8; identical to SEQ ID NO: 6285
  strain IAI1

SEQ ID NO: 22180 - protein, 231 aa, Escherichia coli O8; identical to SEQ ID NO: 6351
  strain IAI1

SEQ ID NO: 22181 - protein, 838 aa, Escherichia coli O8
  strain IAI1
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWNYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFGTPDSEPTTSVLQGTAQCH

SEQ ID NO: 22182 - protein, 678 aa, Escherichia coli O8; identical to SEQ ID NO: 6353
  strain IAI1

SEQ ID NO: 22183 - protein, 331 aa, Escherichia coli O8
  strain IAI1
MELLCPAGNLPALKAAIENGADAVYIGLKDDTNARHFAGLNFTEKKLQEAVSFVHQHRRKLHIAINTFAHPDGYARWQRAVDMAAQLGADALILADLAMLEYAAERYPHIERHVSVQASATNEEAINFYHRHFDVARVVLPRVLSIHQVKQLARVTPVPLEVFAFGSLCIMSEGRCYLSSYLTGESPNTVGACSPARFVRWQQTPQGLESRLNEVLIDRYQDGENAGYPTLCKGRYLVDGERYHALEEPTSLNTLELLPELMAANIASVKIEGRQRSPAYVSQVAKVWRQAIDRCKADPQNFIPQSAWMETLGSMSEGTQTTLGAYHRKWQ

SEQ ID NO: 22184 - protein, 784 aa, Escherichia coli O8; identical to SEQ ID NO: 6283
  strain IAI1

SEQ ID NO: 22185 - protein, 170 aa, Escherichia coli O8 [sequence omitted]

SEQ ID NO: 22186 - protein, 866 aa, Escherichia coli O8
  strain IAI1
MTIKPTKNYHNHLTRIATFCALLYCKSAFCAELVEYDHTFLMGQNASNIDLSRYSEGNPAIPGMYDVSVYVNDQPIINQSITFIEIEGKKNAQACITLKNLLQFHINSPDINNEKAVLLARDETLGNCLNLTEIIPQASVRYDVNEQRLDIDVPQAWVMKNYQNYVDPSLWENGINAAMLSYNLNGYHSETPGRRNDSIYAAFNGGMNLGAWRLRASGNYNWMTDSGSNYDFKNRYIQRDIASLRSQLILGESYTTGETFDSVSIRGIRLYSDSRMLPPTLASFAPIIHGVANTNAKVTITQGGYKIYETTVPPGAFVIDDLSPSGYGSDLIVTVEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSASWGSYSVSAQRSWNEDGDTDDSVYLSFTIPIEKLLGTEQRTSGFQSIDTQMSSDFKGNNQLNVSSSGYSDNARVSYSVNTGYTMNKASKDLSYVGGYASYESPWGSLAGSVSANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEESKPVSCLAHYQQSSEAEKIAQSIILNGIRCQIQ

SEQ ID NO: 22187 - protein, 246 aa, Escherichia coli O8; identical to SEQ ID NO: 15375
  strain IAI1

SEQ ID NO: 22188 - protein, 747 aa, Escherichia coli O8; identical to SEQ ID NO: 6343
  strain IAI1

SEQ ID NO: 22189 - protein, 266 aa, Escherichia coli O8; identical to SEQ ID NO: 5772
  strain IAI1

SEQ ID NO: 22190 - protein, 412 aa, Escherichia coli O8; identical to SEQ ID NO: 6390
  strain IAI1

SEQ ID NO: 22191 - protein, 810 aa, Escherichia coli O8; identical to SEQ ID NO: 6345
  strain IAI1

SEQ ID NO: 22192 - protein, 161 aa, Escherichia coli O8; identical to SEQ ID NO: 5769
  strain IAI1

SEQ ID NO: 22193 - protein, 351 aa, Escherichia coli O8; identical to SEQ ID NO: 5767
  strain IAI1

SEQ ID NO: 22194 - protein, 122 aa, Escherichia coli O8; identical to SEQ ID NO: 5737
  strain IAI1

SEQ ID NO: 22195 - protein, 405 aa, Escherichia coli O8
  strain IAI1
MKIIITREYIMKRKVLAMLVPALLVAGAANAAEIYNKDGNKLDLYGKVAGLHYFSDDASSDGDMSYARIGFKGETQIADQFTGYGQWEFNIGANGPESDKGNTATRLAFAGFGFGQNGTFDYGRNYGVVYDVEAWTDMLPEFGGDTYAGADNFMNGRANSVATYRNNGFFGQVDGLNFALQYQGNNEKSGLFDQEGSGNGNGRKLAKENGDGYGMSTSYDFDFGLSLGAAYSNSDRTDNQVHKGTHNTRYGDRFDATAGGETAEAWTVGAKYDANNVYLAAMYAETRNMTGYGDADAIANKTQNFEVVAQYQFDFGLRPSIAYLQSKGKDLGGVNSDNFDSQGNHHYTNKDLVKYVDIGMTYYFNKNMSTYVDYKINLLDNDDDFYKENGIATDDIVAVGLVYQF

SEQ ID NO: 22196 - protein, 334 aa, Escherichia coli O8; identical to SEQ ID NO: 7357
  strain IAI1

SEQ ID NO: 22197 - protein, 843 aa, Escherichia coli O8; identical to SEQ ID NO: 7909
  strain IAI1

SEQ ID NO: 22198 - protein, 228 aa, Escherichia coli O8; identical to SEQ ID NO: 9270
  strain IAI1

SEQ ID NO: 22199 - protein, 230 aa, Escherichia coli O8; identical to SEQ ID NO: 6294
  strain IAI1

SEQ ID NO: 22200 - protein, 869 aa, Escherichia coli O8
  strain IAI1
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQITLLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKTPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 22201 - protein, 746 aa, Escherichia coli O8; identical to SEQ ID NO: 6296
  strain IAI1

SEQ ID NO: 22202 - protein, 826 aa, Escherichia coli O8; identical to SEQ ID NO: 7342
  strain IAI1

SEQ ID NO: 22203 - protein, 224 aa, Escherichia coli O8; identical to SEQ ID NO: 6435
  strain IAI1

SEQ ID NO: 22204 - protein, 663 aa, Escherichia coli O8
  strain IAI1
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIGGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETRANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 22205 - protein, 243 aa, Escherichia coli O8; identical to SEQ ID NO: 6145
  strain IAI1

SEQ ID NO: 22206 - protein, 193 aa, Escherichia coli O8; identical to SEQ ID NO: 6300
  strain IAI1

SEQ ID NO: 22207 - protein, 251 aa, Escherichia coli O8; identical to SEQ ID NO: 6304
  strain IAI1

SEQ ID NO: 22208 - protein, 833 aa, Escherichia coli O8
  strain IAI1
MAALSPPFIKYLSGMDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPVISSYQPSTVAVNMNDLPDGVTVAENVIKETWIEGAIGYKSLASRSGKDVNVIIRNASGQFPPLGADIRQDDSGISVGMVGEKGHAWLSGVAENQKFTVVWGDSQHCSLHLPEHMEDTANRLILPCH

SEQ ID NO: 22209 - protein, 828 aa, Escherichia coli O8; identical to SEQ ID NO: 6308
  strain IAI1

SEQ ID NO: 22210 - protein, 162 aa, Escherichia coli O8; identical to SEQ ID NO: 6365
  strain IAI1

SEQ ID NO: 22211 - protein, 367 aa, Escherichia coli O8; identical to SEQ ID NO: 5796
  strain IAI1

SEQ ID NO: 22212 - protein, 200 aa, Escherichia coli O8; identical to SEQ ID NO: 6311
  strain IAI1

SEQ ID NO: 22213 - protein, 208 aa, Escherichia coli O8; identical to SEQ ID NO: 5717
  strain IAI1

SEQ ID NO: 22214 - protein, 430 aa, Escherichia coli O8
  strain IAI1
MKQALRVAFGFLILWASVLHAEVRIVIDSGVDSGRPIGVVPFQWVGPGAAPEDIGGIVAADLRNSGKFNPLDRARLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKFPAWSPYL

SEQ ID NO: 22215 - protein, 365 aa, Escherichia coli O8; identical to SEQ ID NO: 7354
  strain IAI1

SEQ ID NO: 22216 - protein, 274 aa, Escherichia coli O8; identical to SEQ ID NO: 6549
  strain IAI1

SEQ ID NO: 22217 - protein, 250 aa, Escherichia coli O8; identical to SEQ ID NO: 6317
  strain IAI1

SEQ ID NO: 22218 - protein, 880 aa, Escherichia coli O8; identical to SEQ ID NO: 6482
  strain IAI1

SEQ ID NO: 22219 - protein, 614 aa, Escherichia coli O8; identical to SEQ ID NO: 6387
  strain IAI1

SEQ ID NO: 22220 - protein, 332 aa, Escherichia coli O8; identical to SEQ ID NO: 6321
  strain IAI1

SEQ ID NO: 22221 - protein, 760 aa, Escherichia coli O8; identical to SEQ ID NO: 9433
  strain IAI1

SEQ ID NO: 22222 - protein, 446 aa, Escherichia coli O8; identical to SEQ ID NO: 6459
  strain IAI1

SEQ ID NO: 22223 - protein, 237 aa, Escherichia coli O8; identical to SEQ ID NO: 6313
  strain IAI1

SEQ ID NO: 22224 - protein, 478 aa, Escherichia coli O8; identical to SEQ ID NO: 5711
  strain IAI1

SEQ ID NO: 22225 - protein, 204 aa, Escherichia coli O8; identical to SEQ ID NO: 5755
  strain IAI1

SEQ ID NO: 22226 - protein, 362 aa, Escherichia coli O8; identical to SEQ ID NO: 5809
  strain IAI1

SEQ ID NO: 22227 - protein, 233 aa, Escherichia coli O8; identical to SEQ ID NO: 6327
  strain IAI1

SEQ ID NO: 22228 - protein, 866 aa, Escherichia coli O8; identical to SEQ ID NO: 6328
  strain IAI1

SEQ ID NO: 22229 - protein, 236 aa, Escherichia coli O8; identical to SEQ ID NO: 6329
  strain IAI1

SEQ ID NO: 22230 - protein, 472 aa, Escherichia coli O8; identical to SEQ ID NO: 7376
  strain IAI1

SEQ ID NO: 22231 - protein, 511 aa, Escherichia coli O8
  strain IAI1
MMKMRWLSAAVMLTLYTSSSWAFSIDDVAKQAQSLAGKGYEAPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSPRATGAYKFVVMPGRDTVVDVQSKIYLREKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 22232 - protein, 191 aa, Escherichia coli O8; identical to SEQ ID NO: 14954
  strain IAI1

SEQ ID NO: 22233 - protein, 232 aa, Escherichia coli O8; identical to SEQ ID NO: 5747
  strain IAI1

SEQ ID NO: 22234 - protein, 365 aa, Escherichia coli O8; identical to SEQ ID NO: 6335
  strain IAI1

SEQ ID NO: 22235 - protein, 368 aa, Escherichia coli O8; identical to SEQ ID NO: 7974
  strain IAI1

SEQ ID NO: 22236 - protein, 241 aa, Escherichia coli O8; identical to SEQ ID NO: 6134
  strain IAI1

SEQ ID NO: 22237 - protein, 878 aa, Escherichia coli O8
  strain IAI1
MSYLNLRLYQRNTQCLHIRKHRLAGFFVRLFVACAFAAQTPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSIIHDATAHLDVGQQRLNLTIPQAFMSNRARGYIPPELWDPGINAGLLNYNFSGNSVQNRIGGNSHYAYLNLQSGLNIGAWRLRDNTSWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCIANYQLPPESQQQLLTQLSAECR

SEQ ID NO: 22238 - protein, 753 aa, Escherichia coli O81; identical to SEQ ID NO: 5801
  strain ED1a

SEQ ID NO: 22239 - protein, 784 aa, Escherichia coli O81; identical to SEQ ID NO: 6829
  strain ED1a

SEQ ID NO: 22240 - protein, 170 aa, Escherichia coli O81; identical to SEQ ID NO: 5855
  strain ED1a

SEQ ID NO: 22241 - protein, 862 aa, Escherichia coli O81
  strain ED1a
MTIKSTNHLTHIATFCALLYSNSALCAELVEYDHTFLMGKDASNIDLSRYTEGNPTLPGIYDVSVYVNDQPIMSQSIAFAVIEGKKNAQACITQKNLLQFHISSPDKNSEKAILLKRDEDLGDCLNLAEMIPQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQELEPKSMRNYSRMKNQVTVSINQPLKFEKKDYGSFYLSGSWSDYWASGQNSTNYSIGYSNSASWGSYSISAQRSLNEDGQTDDSIYLSFTIPIENLLGTEHRSSGFQSIDTQLNSDFKGNNQLNISSSGYSDTNRISYSVNTGYMMNKSSDDLSYIGGYASYESPWGTLSGSASASSDNSRQFSLNTDGGFVLHSGGLTFSNDSFSDSDTLAVIQAPGAKGARINYGNSTVDRWGYGVTSALSPYHENRIALDINDLENDVELKSTSTVAVPRQGAVVFADFETVQGQSAIMNIVRSDGKNIPFAADIYDEQNNIIGNVGQGGQAFVRGIGQEGNIRITWIEEGKPVSCFAHYQQNTTSEKIAQSIIMNGLRCQIQ

SEQ ID NO: 22242 - protein, 246 aa, Escherichia coli O81; identical to SEQ ID NO: 5857
  strain ED1a

SEQ ID NO: 22243 - protein, 752 aa, Escherichia coli O81; identical to SEQ ID NO: 8199
  strain ED1a

SEQ ID NO: 22244 - protein, 266 aa, Escherichia coli O81
  strain ED1a
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVMTGGPDQIPKIKQYWGEQLKIPVIPLTSDWFERASPRIILAAQQLCNALSQVD

SEQ ID NO: 22245 - protein, 810 aa, Escherichia coli O81
  strain ED1a
MAMKKLLIASLLFSSATVYGAEGFVVKDIHFEGLQRVAVGAALLSMPVRTGDAVNDEDISNTIRALFATGNFEDVRVLRDGDTLLVQVKERPTIASITFSGNKSVKDDMLKQNLEASGVRVGESLDRTTIADIEKGLEDFYYSVGKYSASVKAVVTPLPRNRVDLKLVFQEGVSAEIQQINIVGNHAFTTDELISHFQLRDEVPWWNVVGDRKYQKQKLAGDLETLRSYYLDRGYARFNIDSTQVSLTPDKKGIYVTVNITEGDQYKLSGVEVSGNLAGHSAEIEQLTKIEPGELYNGTKVTKMEDDIKKLLGRYGYAYPRVQSMPEINDADKTVKLRVNVDAGNRFYVRKIRFEGNDTSKDAVLRREMRQMEGAWLGSDLVDQGKERLNRLGFFETVDTDTQRVPGSPDQVDVVYKVKERNTGSFNFGIGYGTESGVSFQAGVQQDNWLGTGYAVGINGTKNDYQTYAELSVTNPYFTVDGVSLGGRLFYNDFQADDADLSDYTNKSYGTDVTLGFPINEYNSLRAGLGYVHNSLSNMQPQVAMWRYLYSMGEHPSTSDQDNSFKTDDFTFNYGWTYNKLDRGYFPTDGSRVNLTGKVTIPGSDNEYYKVTLDTATYVPIDDDHKWVVLGRTRWGYGDGLGGKEMPFYENFYAGGSSTVRGFQSNTIGPKAVYFPHQASNYDPDYDYECATQDGAKDLCKSDDAVGGNAMAVASLEFITPTPFISDKYANSVRTSFFWDMGTVWDTNWDSSQYSGYPDYSDPSNIRMSAGIALQWMSPLGPLVFSYAQPFKKYDGDKAEQFQFNIGKTW

SEQ ID NO: 22246 - protein, 161 aa, Escherichia coli O81; identical to SEQ ID NO: 5769
  strain ED1a

SEQ ID NO: 22247 - protein, 430 aa, Escherichia coli O81; identical to SEQ ID NO: 5758
  strain ED1a

SEQ ID NO: 22248 - protein, 351 aa, Escherichia coli O81; identical to SEQ ID NO: 8304
  strain ED1a

SEQ ID NO: 22249 - protein, 332 aa, Escherichia coli O81; identical to SEQ ID NO: 5870
  strain ED1a

SEQ ID NO: 22250 - protein, 760 aa, Escherichia coli O81; identical to SEQ ID NO: 17707
  strain ED1a

SEQ ID NO: 22251 - protein, 696 aa, Escherichia coli O81; identical to SEQ ID NO: 6320
  strain ED1a

SEQ ID NO: 22252 - protein, 759 aa, Escherichia coli O81; identical to SEQ ID NO: 6319
  strain ED1a

SEQ ID NO: 22253 - protein, 193 aa, Escherichia coli O81; identical to SEQ ID NO: 5868
  strain ED1a

SEQ ID NO: 22254 - protein, 204 aa, Escherichia coli O81; identical to SEQ ID NO: 5755
  strain ED1a

SEQ ID NO: 22255 - protein, 362 aa, Escherichia coli O81; identical to SEQ ID NO: 5874
  strain ED1a

SEQ ID NO: 22256 - protein, 237 aa, Escherichia coli O81
  strain ED1a
MRKITQALSAVCLLFALNSSAVALASSPSPLNPGTNVAKLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGIRILRASNSTYKPLPPAGAFGEEVIVNSEY

SEQ ID NO: 22257 - protein, 774 aa, Escherichia coli O81; identical to SEQ ID NO: 8008
  strain ED1a

SEQ ID NO: 22258 - protein, 368 aa, Escherichia coli O81
  strain ED1a
MNKTITALAILMASFAANASVLPETPVPFKSGTGVIDNDTVYIGLGSAGTAWYKLDTQAKDKRWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAYYFDKKAEDYFFNKFLLSFDPSTQQWSYAGESPWYGTAGAAVVNKGDKTWLINGEAKPGLRTDAVFELDFTGNNLKWNKLAPVASPDGVAGGFAGMSNDSLIFAGGAGFKGSRENYQNGKNYAHEGLKKSYSADIHLWHNGKWDKSGELSQGRAYGVSLPWNNSLLIIGGETAGGKAVTDSVLISVKDNKVTVQN

SEQ ID NO: 22259 - protein, 241 aa, Escherichia coli O81
  strain ED1a
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDREILFWMNVKAIPSMDKSKLTENTLQLAIISRIKLYYRPAKLALPPDQAAEKLRFRRSANSLTLINPTPYYLTVTELNAGTRVLENALVPPMGESAVKLPSDAGSNITYRTINDYGALTPKMTGVME

SEQ ID NO: 22260 - protein, 511 aa, Escherichia coli O81; identical to SEQ ID NO: 5749
  strain ED1a

SEQ ID NO: 22261 - protein, 191 aa, Escherichia coli O81
  strain ED1a
MKKSLLGLTFASLMFSAGSAVAADYKINKEGQHAFVNFRIQHLGYSWLYGTFKDFDGTFTFDEKNPAADKVNVTINTTSVDTNHAERDKHLRSADFLNTAKYPQATFTSTSVKKDGDELDITGDLTLNGVTKPVTLEAKLIGQGDDPWGGKRAGFEAEGKIELKDFNIKTDLGPASQEVDLIISVEGVQQK

SEQ ID NO: 22262 - protein, 232 aa, Escherichia coli O81; identical to SEQ ID NO: 5747
  strain ED1a

SEQ ID NO: 22263 - protein, 365 aa, Escherichia coli O81; identical to SEQ ID NO: 19099
  strain ED1a

SEQ ID NO: 22264 - protein, 729 aa, Escherichia coli O81
  strain ED1a
MLSTQFNRDNQHQAIIKPSLLAGCIALALLPSAAFAAPVTEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKAFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 22265 - protein, 213 aa, Escherichia coli O81; identical to SEQ ID NO: 5744
  strain ED1a

SEQ ID NO: 22266 - protein, 203 aa, Escherichia coli O81; identical to SEQ ID NO: 7450
  strain ED1a

SEQ ID NO: 22267 - protein, 663 aa, Escherichia coli O81
  strain ED1a
MLNGIYSMRLKKRYLCTVLSLAFTQQSVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNYQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTLKPWEPLSVTLSEEARSSSYSNSDGSQKAAGFAVTHIRADYTLGHGFSVNASVNNLFDTKYAYSEGFIEEGRNFWAGIEYTF

SEQ ID NO: 22268 - protein, 207 aa, Escherichia coli O81; identical to SEQ ID NO: 7443
  strain ED1a

SEQ ID NO: 22269 - protein, 407 aa, Escherichia coli O81
  strain ED1a
MNERELSIIRALGEEFAAVITDLQRTFEEKMAAQAQQSEEKLASLSAVLQKHVTLDEVRSVLQAMVDDAVGAIPVPRDGRDYDPDVLQKAVNDAVANIPLPADGKSITPDDVRPMLEQMVKEAVSHIPVPRDGRDYDPDVLQKAVNDAVANIPLPADGKSITPDDVRPMLEQMVKEAVSHIPVPRDGRDYDPDVLQKAVNDAVANIPQPADGKSLTPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERSFTVVVRQSSGQRTEKTFSLPVMLYRGVFRAGETYHPGDTVTWGGSLWHCNSMTEDKPGEAHSSAWTLAAKRGRDAGGGK

SEQ ID NO: 22270 - protein, 387 aa, Escherichia coli O81
  strain ED1a
MKKMTVALSAVAAAVIFAAGAQAAEVYNKDGNKLDVYGRATALHYFSSDKGDDGDKTYARLGFKGETQINDQLTGFGQWEYQFSGNKAESEGAAGNKTRLAFAGLKFGEFGTIDYGRNYGIAYDVGSYTDVLPEFGGDGWTQTDNFMTARTSGVLTYRNTDFFGLVDGLNFAAQYQGKNDRGDLRKANGDGHGFSASYEYEGFGIVAAYINADRTNNQEKGLNGTLTIEQTDPLTGKVTEKQIVVDSGSVAKGKHAEMWGVGLKYDADNLYLATTYSETQNLTTFGDKGVADKAQNFEAVLQYQFDFGLRPSLAFLQSRAQDVIVGGKNYGDQDLVKYVDVGAKYYFNKNMSTYVDYKINLVDENKFTRDAGIATDDIVAVGMTYQF

SEQ ID NO: 22271 - protein, 541 aa, Escherichia coli O81; identical to SEQ ID NO: 15907
  strain ED1a

SEQ ID NO: 22272 - protein, 700 aa, Escherichia coli O81; identical to SEQ ID NO: 6848
  strain ED1a

SEQ ID NO: 22273 - protein, 407 aa, Escherichia coli O81
  strain ED1a
MNERELSIIRALGEEFSAVLADLQRTFEGKIAAQAQQSEEKLASLSAVLQKHVTLDEVRSVLQAMVDDAVGAIPVPRDGRDYDPDVLQKAVNDAVANIPLPADGKSITPDDVRPMLEQMVKEAVSHIPVPRDGRDYDPDVLQKAVNDAVANIPLPADGKSITPDDVRPMLEQMVKEAVSHIPVPRDGRDYDPDVLQKAVNDAVANIPLPADGKSITPDDVRPMLEQMVKEAVSHIPVPRDGRDYDPDVLQKAVNDAVSALPVPQDGRDATALEILPAIDDQKSFPRGTYATHQGGLWRAYEKTHGMRGWECLVDGVADIDVSMIGERSFSVVIRQSSGQCTEKTFSLPVMLYRGVFRAGEIYHPGDTVTWGGSLWHCNSMTGDKPGDIHSSGWTLAAKRGRDAGGGK

SEQ ID NO: 22274 - protein, 102 aa, Escherichia coli O81
  strain ED1a
MKKVLALVVAAAMGLSSAAFAAETAITPAPTATTTKAAPAKTTHHKKQHKAAPAQKAQAAKKHHKNAKAEQKAPEQKAQAAKKHAKKHSHQQPAKPAAQPAA

SEQ ID NO: 22275 - protein, 122 aa, Escherichia coli O81; identical to SEQ ID NO: 5737
  strain ED1a

SEQ ID NO: 22276 - protein, 334 aa, Escherichia coli O81; identical to SEQ ID NO: 6566
  strain ED1a

SEQ ID NO: 22277 - protein, 673 aa, Escherichia coli O81; identical to SEQ ID NO: 6092
  strain ED1a

SEQ ID NO: 22278 - protein, 826 aa, Escherichia coli O81
  strain ED1a
MLRMTPLASAIVALLIGIEAYAAEETFDTHFMIGGMKDQQVVNIRLEDNQPLPGQYDIDIYVNKQWRGKYEIIVKDNPQETCLSREMIKRLGINTDNFASGKQCLTFKQLIQGGSYTWDIGVFRLDFSVPQAWVEELESGYVPPENWERGINAFYTSYYVSQYYSDYKASGNSKSTYVRFNSGLNLQEWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGHQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRHDENDIYDIADYYQNDFGRKNSFSANMSQSLPEGWGSVSLSTLWRDYWGRSGSSKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESKNYICQ

SEQ ID NO: 22279 - protein, 224 aa, Escherichia coli O81; identical to SEQ ID NO: 17196
  strain ED1a

SEQ ID NO: 22280 - protein, 200 aa, Escherichia coli O81; identical to SEQ ID NO: 5898
  strain ED1a

SEQ ID NO: 22281 - protein, 641 aa, Escherichia coli O81; identical to SEQ ID NO: 8755
  strain ED1a

SEQ ID NO: 22282 - protein, 828 aa, Escherichia coli O81
  strain ED1a
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEDKFKTALKEKGPESIGMFGSGQWTIWEGYAASKLFKAGFRSNNIDPNARHCMASAVVGFMRTFGMDEPMGCYDDIEQADAFVLWGSNMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYDVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 22283 - protein, 162 aa, Escherichia coli O81; identical to SEQ ID NO: 5896
  strain ED1a

SEQ ID NO: 22284 - protein, 375 aa, Escherichia coli O81; identical to SEQ ID NO: 5897
  strain ED1a

SEQ ID NO: 22285 - protein, 274 aa, Escherichia coli O81; identical to SEQ ID NO: 5899
  strain ED1a

SEQ ID NO: 22286 - protein, 250 aa, Escherichia coli O81
  strain ED1a
MSYKLSCPMLVSTALMAQLTTASLTAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRKPWQFKVTLTRSGQDYTVNNPTPYHVIISDASTQKKGLTAAGFKPLVMPPKTSQPLKAKMASAPVLTYINDYGARMPLIFRCEGNTCKVDEDQSSKG

SEQ ID NO: 22287 - protein, 884 aa, Escherichia coli O81
  strain ED1a
MCMPNHSNFRLRGIACYIALAISGGSVNAWADDSIQFDPRFLELKGDTKIDLGKFSKKGYVDAGKYNLRVFINKHPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKHWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSADGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNADEHMMVFWEGSAQCEIVLPKPLPADLFSGLLLPCEQKGTAAPDSSAPEIKPVIQGQTRQVTPTEAPRSISATQ

SEQ ID NO: 22288 - protein, 472 aa, Escherichia coli O81
  strain ED1a
MSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKDTKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTKLGKEKFPFLSFLSQSSSNYLTHTPSLLFSRKGSEEKQN

SEQ ID NO: 22289 - protein, 432 aa, Escherichia coli O81; identical to SEQ ID NO: 5727
  strain ED1a

SEQ ID NO: 22290 - protein, 359 aa, Escherichia coli O81
  strain ED1a
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGMRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 22291 - protein, 686 aa, Escherichia coli O81
  strain ED1a
MFWRDMTLSIWRKKTTGLKTKKRLLPLMLAAALCSSPVWAEEATFTANFKDTDLKSFIETVGANLNKTIIMGPGVQGKVSIRTMTPLNERQYYQLFLNLLEAQGYAVVPMENDVLKVVKSSAVKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 22292 - protein, 682 aa, Escherichia coli O81
  strain ED1a
MKTKSIIAPGIAVICSTVISSGYASSDKKEDTLVVTASGFTQQLRNAPASVSVITSEQLQKKPVSDLVDAVKDVEGISITGGNEKPDISIRGLSGDYTLILVDGRRQSGRESRPNGSGGFEAGFIPPVEAIERIEVIRGPMSSLYGSDAIGGVINIITKPVNNQTWDGVLGLGGIIQEHGKFGNSTTNDFYLSGPLVKDKLGLQLYGGMNYRKEDSISQGTPAKNNKNITATLQFTPTESQKFVFEYGKNNQEHTLTPGDSLDAWTMRGNLKQPNSKRETHNSRSHWVAAWNAQGEILHPEIAVYQEKVIREVKSGKKDKYNHWDLNYESRKPEITNTIIDAKVTAFLPENVLTIGGQFQHAELRDDSATGKKTTETQSVSVKQKAVFIENEYAATDSLALTGGLRLDNHEIYGSYWNPRLYAVYNLTDNLTLKGGIAKAFRAPSIREVSPGFGTLTQGGASIMYGNRDLKPETSVTEEIGIIYNNDSGFSASATLFNTDFKNKLTSYDIGTKDPVTGLNTFIYDNVGEANIRGVELATQIPVYDKWRVSANYTFTDSRRESDDESLNGKSLKGEPLERTPRHAANAKLEWDYTQDITFYSSLNYTGKQIWAAQRNGAKVPRVRNGFTSMDIGMNYQFLPGTLINFAVLNVTDRKSEDIDTIDGNWQVDEGRRYWANVRISF

SEQ ID NO: 22293 - protein, 696 aa, Escherichia coli O81
  strain ED1a
MRITTLASVIIPCLGFSASSMAAAEDVMIVSASGYEKKLTNAAASVSVISQEELQSRQYHDLAEALRSVEGVDVESGTGKTGGLEISIRGMPASYTLILIDGVRQGGSSDVTPNGFSAMNTGFMPPLAAIERIEVIRGPMSTLYGSDAMGGVVNIITRKNADKWLSSVNAGLNLQESNKWGNSSQFNFWTSGPLVDDSVSLQVRGSTQQRQGSSVTSLSDTAATRIPYPTESQNYNIGARLDWKATEQDVLWFDMDTTRQRYDNRDGQLGSLTGGYDRTLRYERNKISAGYDHSFTFGTWKSYLNWNETENKGRELVQSVLKRDKWELAGQPRELKESNFILNSLLLTPLGESHLVTVGGEYQSSSMKDGVVLASTGETFRQKSWSVFAEDEWHLTDALALTAGSRYEHHEQFGGHFSPRAYLVWDVADAWTLKGGVTTGYKAPTMGQLHKGISGVSGQGRTNLLGNPELKPEESVSYEAGVYYDNLSGLNANITGFITDFSNKIVSYSIDDNTNSYTNSGKARLHGVEFAGTLPLWSEDVTLSLNYTWTRSEQRDGDNKGAPLSYTPEHMVNAKLNWQITEEVASWLGARYRDKTPRFTRNYSSLSAVQKKVYDEKGEYLKAWTVVDAGLSWKVTDALTLNAAVNNLLNKDYSDVSLYSAGKSTLYAGDYFQTGSSTTGYVIPERNYWMSLNYQF

SEQ ID NO: 22294 - protein, 678 aa, Escherichia coli O81
  strain ED1a
MVPSTFSRLKAARCLPVVLAALIFAGCGTHTPDQSTAYMQGTAQADSAFYLQQMQQSSDDTRINWQLLAIRALVKEGKTGQAVELFNQLPQELNDTQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVNGVASPAQASVSDLTGEQPATQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRETTDSGMTTNNPTLQTTPTDDQFTNNGGRVDAVYIVATPGAIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 22295 - protein, 713 aa, Escherichia coli O81
  strain ED1a
MAMFTPSFSGLKGRALFSLLFAAPMIHATDSVTTKDGETITVTADANTATEATDGYQPLSTSTATLTDMPMLDIPQVVNTVSDQVLENQNATMLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 22296 - protein, 222 aa, Escherichia coli O81; identical to SEQ ID NO: 5850
  strain ED1a

SEQ ID NO: 22297 - protein, 840 aa, Escherichia coli O81
  strain ED1a
MNNKNTFSRDKLSHAIKNALSGVVCSLLFVLPVHAVEFNVDMIDAEDRENIDISRFEKKGYILPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDTGIAGFILDYNVYASQYAPHHGDSTQNVSSYGTLGFNLGAWRLRSDYQYNQNFADGRSVNRDSEFARTYLFRPIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSGNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGIEINSNRTVTNGLGIAVIPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSTLHLTWGDNTCEVTPPNQSNISESAIILPCKTVK

SEQ ID NO: 22298 - protein, 249 aa, Escherichia coli O81
  strain ED1a
MNIMKSPLITTGMICLLGICNFAQATVSPDRTRIIFNASNKSATVRLTNQSKIDPYLAQSWIEDASGKKTRDYISTLPPMERIEPDEQIQIRLMALASLNDLPQDRETLFYYNVREIPPRAKEQNVMQIAMQSRLKLFWRPKAIELKEGEMIPLQKVTITRTAAGLTLNNPTPYHITVGYIGTNGKTLMPGADSIMVAPFTSATQHLSSLPSTFQLGFVADYGGLEMFKVECSSIQSLCQSSPAKKGKI

SEQ ID NO: 22299 - protein, 331 aa, Escherichia coli O81; identical to SEQ ID NO: 5720
  strain ED1a

SEQ ID NO: 22300 - protein, 412 aa, Escherichia coli O81
  strain ED1a
MKQWIAALLLMLIPGVQAAKPQKVTLMVDDVPVAQVLQVLAEQEKLNLVVSPDVSGTVSLHLTDVPWKQALQTVVKSAGLITRQEGNILSVHSVAWQNDNIARQEAEQTRAQANLPLENRNITLQYADAGELAKAGEKLLSAKGSMTVDKRTNRLLLRDNKTALSTLEQWVSQMDLPVGQVELSAHIVTINEKSLRELGVKWTLADAQQAGGVGQVTTLGSDLSVATATTHIGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFHHDGKEDERRELVVFITPRLVSSE

SEQ ID NO: 22301 - protein, 650 aa, Escherichia coli O81; identical to SEQ ID NO: 5858
  strain ED1a

SEQ ID NO: 22302 - protein, 841 aa, Escherichia coli O81
  strain ED1a
MKLNIFTKSMIGMGLVCSALPALAMEAWNNQQGGNKYQVIFDGKIYENAWWVSSTNCPGKAKANDATNPWRLKRTATAAEISQFGNTLSCEKSGSSSSSTSNTPASNTPANGGSATPAQGTVPSNSSVVAWNKQQGGQTWYVVFNGAVYKNAWWVASSNCPGDAKGNDASNPWRYVRAATATEISETSNPQSCTSAPQPAPDVKPAPDVKPAPDVQPAPADKSNDNYAVVAWKGQEGSSTWYVIYNGSIYKNAWWVGAANCPGDAKENDASNPWRYVRAATATEITQYGNPGSCSVKPDNNGGAVTPVDPTPETPETPVTPTPDNNEPSTPADSSNDYSLQAWSGQEGSEIYHVIFNGNVYQNAWWVGSEDCPRGTSVENSNNPWRLVRTATAAEMSQYGNPTTCEIDNGGVIIADGFQASKAYSASSIVDYNDAHYKTSVDQDAWGFVPGGDNPWKKYEPAKAWSASTVYVKGDRVVVDGQAYEALFWTQSDNPALIANQNATGSNSRPWKPLGKTQSYSNEELNNAPQFNPETLYASDTLIRFNGENYISQSKVQKVSPSDSNPWRVFVDWTGTKERVGTPKKAWPKHVYAPYVDFTLNTIPDLAALAKNHNVNHFTLAFVVSKDANTCLPTWGTAYGMQNYAQYSKIKALREAGGDVMLSIGGANNAPLAASCKNVDDLMQHYYDIVDNLNLRVLDFDIEGTWVADQASIERRNLAVKKVQDKWKSEGKDIAIWYTLPILPTGLTPEGMNVLSDAKAKGVELAGVNVMTMDYGNAICQSANTEGQNIHGKCATSAIANLHAQLKGLYGAMARRRLALVKVIFCAVKAWRIIGINIVSD

SEQ ID NO: 22303 - protein, 264 aa, Escherichia coli O81
  strain ED1a
MSNQGMPMRQYRLLSPMIKVVIVLFSLLFSTAQAGLVIGGTRFAYPENQSSISVELKNTSDRDMLVKVAVSPDDARQLTGTVESLPSYSETVFIATPPLFVLKPDKNTKIRINRVGGSLPTDRESLFILNVAALPTLENSHSVKIDNQLQIAVRNRMKIFYRPSNLSEDPNMSYQKLRWARKNEMVTVYNPGPRYVTLYNLHVDGKVIDGGMVAPFSHRQQSWCKSQGVCEIAWQTLDVYNNVLPILKVKLNPSQLGNAANLLI

SEQ ID NO: 22304 - protein, 259 aa, Escherichia coli O81
  strain ED1a
MLFHQQGCCMKCIIGNKKWVYGFRDELKVSQNIIRSGILFLLSILFINNASAGGFGLGVTRLIYPAESKQITLSVQNSGDNTSYLIQSWVDDSKTEKKSQDFVITPPLFMLPTRKEASLRIMFLGKTNLPTDRETLYWMNVKAIPPTDEKNTQKNTLQLALQNKIKLFYRPENLPVQPGKARNMLRFKYEGKQLKVINPSPYYLTLTGIKVQGSKLPNMFVPPKSDITVSSPVTLAGEITYQTINDFGATTERQKGIMQ

SEQ ID NO: 22305 - protein, 843 aa, Escherichia coli O81
  strain ED1a
MHWMHLPLDHYRAHFSFSLLALTIASALPAYGGKFNPKFLENVQGIDQHVDLSVYDFPVGQQIPGKYRVFVFVNEEKMASRTLDFSTASEAQRKASGESLMPCLSRVQLEEMGVRVDSFPALKILPPEACVAFDEIIPQATSRFDFNTQTLHLTFPQAAMMMTARGTVDPSRWDEGIPALLLDYSFSGSNGRNEGSGSSPDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKESDGSEQRFIQPFSAVAIFQREGYLKYSLAAGEYRAGNYDSGKPRFGQFTAMYGLPWGMTAYGGALLSADYNALALGLGKNFGTIGAVSVDVTQAKSQLRNNEKDEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSIAYTWTRSPEWDEDDRLWSFSLSIPLGGAWGSYRMTTDQNGKTSQQASVSGTLLEDRNLNYNVQQGYTSNGVGNSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAIVRSRFDTRVGYRVLMSLKRANGNAVPFGATAALSDESKPASSIVGEEGQLYISGMPEEGELQVSWGHEQAQRCRVPFRLPEKKDNSGIVMVNAVCDK

SEQ ID NO: 22306 - protein, 228 aa, Escherichia coli O81; identical to SEQ ID NO: 5866
  strain ED1a

SEQ ID NO: 22307 - protein, 208 aa, Escherichia coli O81; identical to SEQ ID NO: 5869
  strain ED1a

SEQ ID NO: 22308 - protein, 446 aa, Escherichia coli O81; identical to SEQ ID NO: 5873
  strain ED1a

SEQ ID NO: 22309 - protein, 478 aa, Escherichia coli O81
  strain ED1a
MTRIKINARRIFSLLIPFFFFTSVHAEQTAAPATPVTVEAKNKTFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 22310 - protein, 360 aa, Escherichia coli O83:H1; identical to SEQ ID NO: 5879
  strain NRG 857C / AIEC

SEQ ID NO: 22311 - protein, 203 aa, Escherichia coli O83:H1; identical to SEQ ID NO: 7450
  strain NRG 857C / AIEC

SEQ ID NO: 22312 - protein, 656 aa, Escherichia coli O83:H1; identical to SEQ ID NO: 5880
  strain NRG 857C / AIEC

SEQ ID NO: 22313 - protein, 565 aa, Escherichia coli O83:H1; identical to SEQ ID NO: 5881
  strain NRG 857C / AIEC

SEQ ID NO: 22314 - protein, 229 aa, Escherichia coli O83:H1; identical to SEQ ID NO: 16536
  strain NRG 857C / AIEC

SEQ ID NO: 22315 - protein, 784 aa, Escherichia coli O83:H1; identical to SEQ ID NO: 16516
  strain NRG 857C / AIEC

SEQ ID NO: 22316 - protein, 518 aa, Escherichia coli O83:H1; identical to SEQ ID NO: 5902
  strain NRG 857C / AIEC

SEQ ID NO: 22317 - protein, 208 aa, Escherichia coli O83:H1; identical to SEQ ID NO: 5869
  strain NRG 857C / AIEC

SEQ ID NO: 22318 - protein, 170 aa, Escherichia coli O83:H1; identical to SEQ ID NO: 5855
  strain NRG 857C / AIEC

SEQ ID NO: 22319 - protein, 862 aa, Escherichia coli O83:H1; identical to SEQ ID NO: 5856
  strain NRG 857C / AIEC

SEQ ID NO: 22320 - protein, 246 aa, Escherichia coli O83:H1; identical to SEQ ID NO: 5857
  strain NRG 857C / AIEC

SEQ ID NO: 22321 - protein, 747 aa, Escherichia coli O83:H1; identical to SEQ ID NO: 7499
  strain NRG 857C / AIEC

SEQ ID NO: 22322 - protein, 266 aa, Escherichia coli O83:H1; identical to SEQ ID NO: 5772
  strain NRG 857C / AIEC

SEQ ID NO: 22323 - protein, 551 aa, Escherichia coli O83:H1; identical to SEQ ID NO: 5885
  strain NRG 857C / AIEC

SEQ ID NO: 22324 - protein, 161 aa, Escherichia coli O83:H1; identical to SEQ ID NO: 5769
  strain NRG 857C / AIEC

SEQ ID NO: 22325 - protein, 700 aa, Escherichia coli O83:H1; identical to SEQ ID NO: 5886
  strain NRG 857C / AIEC

SEQ ID NO: 22326 - protein, 883 aa, Escherichia coli O83:H1; identical to SEQ ID NO: 5887
  strain NRG 857C / AIEC

SEQ ID NO: 22327 - protein, 239 aa, Escherichia coli O83:H1; identical to SEQ ID NO: 5888
  strain NRG 857C / AIEC

SEQ ID NO: 22328 - protein, 432 aa, Escherichia coli O83:H1; identical to SEQ ID NO: 5727
  strain NRG 857C / AIEC

SEQ ID NO: 22329 - protein, 614 aa, Escherichia coli O83:H1; identical to SEQ ID NO: 5872
  strain NRG 857C / AIEC

SEQ ID NO: 22330 - protein, 351 aa, Escherichia coli O83:H1; identical to SEQ ID NO: 5863
  strain NRG 857C / AIEC

SEQ ID NO: 22331 - protein, 446 aa, Escherichia coli O83:H1; identical to SEQ ID NO: 5873
  strain NRG 857C / AIEC

SEQ ID NO: 22332 - protein, 237 aa, Escherichia coli O83:H1; identical to SEQ ID NO: 5875
  strain NRG 857C / AIEC

SEQ ID NO: 22333 - protein, 478 aa, Escherichia coli O83:H1; identical to SEQ ID NO: 5876
  strain NRG 857C / AIEC

SEQ ID NO: 22334 - protein, 111 aa, Escherichia coli O83:H1; identical to SEQ ID NO: 5889
  strain NRG 857C / AIEC

SEQ ID NO: 22335 - protein, 359 aa, Escherichia coli O83:H1; identical to SEQ ID NO: 5847
  strain NRG 857C / AIEC

SEQ ID NO: 22336 - protein, 686 aa, Escherichia coli O83:H1; identical to SEQ ID NO: 7831
  strain NRG 857C / AIEC

SEQ ID NO: 22337 - protein, 749 aa, Escherichia coli O83:H1; identical to SEQ ID NO: 5867
  strain NRG 857C / AIEC

SEQ ID NO: 22338 - protein, 713 aa, Escherichia coli O83:H1; identical to SEQ ID NO: 5849
  strain NRG 857C / AIEC

SEQ ID NO: 22339 - protein, 222 aa, Escherichia coli O83:H1; identical to SEQ ID NO: 5850
  strain NRG 857C / AIEC

SEQ ID NO: 22340 - protein, 840 aa, Escherichia coli O83:H1; identical to SEQ ID NO: 5851
  strain NRG 857C / AIEC

SEQ ID NO: 22341 - protein, 249 aa, Escherichia coli O83:H1; identical to SEQ ID NO: 5852
  strain NRG 857C / AIEC

SEQ ID NO: 22342 - protein, 193 aa, Escherichia coli O83:H1; identical to SEQ ID NO: 5868
  strain NRG 857C / AIEC

SEQ ID NO: 22343 - protein, 118 aa, Escherichia coli O83:H1; identical to SEQ ID NO: 5890
  strain NRG 857C / AIEC

SEQ ID NO: 22344 - protein, 678 aa, Escherichia coli O83:H1; identical to SEQ ID NO: 5853
  strain NRG 857C / AIEC

SEQ ID NO: 22345 - protein, 368 aa, Escherichia coli O83:H1; identical to SEQ ID NO: 5883
  strain NRG 857C / AIEC

SEQ ID NO: 22346 - protein, 241 aa, Escherichia coli O83:H1; identical to SEQ ID NO: 6139
  strain NRG 857C / AIEC

SEQ ID NO: 22347 - protein, 878 aa, Escherichia coli O83:H1; identical to SEQ ID NO: 5884
  strain NRG 857C / AIEC

SEQ ID NO: 22348 - protein, 430 aa, Escherichia coli O83:H1; identical to SEQ ID NO: 5758
  strain NRG 857C / AIEC

SEQ ID NO: 22349 - protein, 360 aa, Escherichia coli O83:H1; identical to SEQ ID NO: 5891
  strain NRG 857C / AIEC

SEQ ID NO: 22350 - protein, 334 aa, Escherichia coli O83:H1; identical to SEQ ID NO: 6798
  strain NRG 857C / AIEC

SEQ ID NO: 22351 - protein, 332 aa, Escherichia coli O83:H1; identical to SEQ ID NO: 5870
  strain NRG 857C / AIEC

SEQ ID NO: 22352 - protein, 760 aa, Escherichia coli O83:H1; identical to SEQ ID NO: 5871
  strain NRG 857C / AIEC

SEQ ID NO: 22353 - protein, 673 aa, Escherichia coli O83:H1; identical to SEQ ID NO: 6170
  strain NRG 857C / AIEC

SEQ ID NO: 22354 - protein, 654 aa, Escherichia coli O83:H1; identical to SEQ ID NO: 8265
  strain NRG 857C / AIEC

SEQ ID NO: 22355 - protein, 900 aa, Escherichia coli O83:H1; identical to SEQ ID NO: 5859
  strain NRG 857C / AIEC

SEQ ID NO: 22356 - protein, 203 aa, Escherichia coli O83:H1; identical to SEQ ID NO: 6414
  strain NRG 857C / AIEC

SEQ ID NO: 22357 - protein, 362 aa, Escherichia coli O83:H1; identical to SEQ ID NO: 5874
  strain NRG 857C / AIEC

SEQ ID NO: 22358 - protein, 826 aa, Escherichia coli O83:H1; identical to SEQ ID NO: 5892
  strain NRG 857C / AIEC

SEQ ID NO: 22359 - protein, 224 aa, Escherichia coli O83:H1; identical to SEQ ID NO: 5893
  strain NRG 857C / AIEC

SEQ ID NO: 22360 - protein, 412 aa, Escherichia coli O83:H1; identical to SEQ ID NO: 7596
  strain NRG 857C / AIEC

SEQ ID NO: 22361 - protein, 265 aa, Escherichia coli O83:H1
  strain NRG 857C / AIEC
MSNQGMQMRQYRLLSPMIKVVIVLFSLLFSTAQAGLVIGGTRFAYPENQSSISVELKNTSNRDMLVKVAVSPDDARQLTGTVESLPSYSETVFIATPPLFVLKPDKNTKIRINRVGGSLPTDRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDIYNNVLPILKVKLNPSQLDVTGFAFSQ

SEQ ID NO: 22362 - protein, 663 aa, Escherichia coli O83:H1; identical to SEQ ID NO: 5894
  strain NRG 857C / AIEC

SEQ ID NO: 22363 - protein, 259 aa, Escherichia coli O83:H1; identical to SEQ ID NO: 6832
  strain NRG 857C / AIEC

SEQ ID NO: 22364 - protein, 660 aa, Escherichia coli O83:H1; identical to SEQ ID NO: 5864
  strain NRG 857C / AIEC

SEQ ID NO: 22365 - protein, 517 aa, Escherichia coli O83:H1; identical to SEQ ID NO: 6817
  strain NRG 857C / AIEC

SEQ ID NO: 22366 - protein, 191 aa, Escherichia coli O83:H1; identical to SEQ ID NO: 5877
  strain NRG 857C / AIEC

SEQ ID NO: 22367 - protein, 828 aa, Escherichia coli O83:H1; identical to SEQ ID NO: 5895
  strain NRG 857C / AIEC

SEQ ID NO: 22368 - protein, 162 aa, Escherichia coli O83:H1; identical to SEQ ID NO: 5896
  strain NRG 857C / AIEC

SEQ ID NO: 22369 - protein, 375 aa, Escherichia coli O83:H1; identical to SEQ ID NO: 5897
  strain NRG 857C / AIEC

SEQ ID NO: 22370 - protein, 200 aa, Escherichia coli O83:H1; identical to SEQ ID NO: 5898
  strain NRG 857C / AIEC

SEQ ID NO: 22371 - protein, 843 aa, Escherichia coli O83:H1; identical to SEQ ID NO: 5865
  strain NRG 857C / AIEC

SEQ ID NO: 22372 - protein, 228 aa, Escherichia coli O83:H1; identical to SEQ ID NO: 5866
  strain NRG 857C / AIEC

SEQ ID NO: 22373 - protein, 232 aa, Escherichia coli O83:H1; identical to SEQ ID NO: 5747
  strain NRG 857C / AIEC

SEQ ID NO: 22374 - protein, 366 aa, Escherichia coli O83:H1
  strain NRG 857C / AIEC
MVIKFLSALILLLVTTAAQAERIRDLTSVQGVRQNSLIGYGLVVGLDGTGDQTTQTPFTTQTLNNMLSQLGITVPTGTNMQLKNVAAVMVTASLPPFGRQGQTIDVVVSSMGNAKSLRGGTLLMTPLKGVDSQVYALAQGNILVGGAGASAGGSSVQVNQLNGGRITNGAVIERELPSQFGVGNALNLQLNDEDFSMAQQIADTINRVRGYGSATALDARTIQVRVPSGNSSQVRFLADIQNMQVNVTPQDAKVVINSRTGSVVMNREVTLDSCAVAQGNLSVTVNRQANVSQPDTPFGGGQTVVTPQTQIDLRQSGGSLQSVRSSASLNNVVRALNALGATPMDLMSILQSMQSAGCLRAKLEII

SEQ ID NO: 22375 - protein, 729 aa, Escherichia coli O83:H1; identical to SEQ ID NO: 5878
  strain NRG 857C / AIEC

SEQ ID NO: 22376 - protein, 213 aa, Escherichia coli O83:H1; identical to SEQ ID NO: 5744
  strain NRG 857C / AIEC

SEQ ID NO: 22377 - protein, 274 aa, Escherichia coli O83:H1; identical to SEQ ID NO: 5899
  strain NRG 857C / AIEC

SEQ ID NO: 22378 - protein, 250 aa, Escherichia coli O83:H1; identical to SEQ ID NO: 5900
  strain NRG 857C / AIEC

SEQ ID NO: 22379 - protein, 882 aa, Escherichia coli O83:H1
  strain NRG 857C / AIEC
MPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKHWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASVPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNAGEHMMVFWEGSAQCEIVLPKPLPADLFSGLLLPCEQKGTAAPDSSAPEIKPVIQDQTRQVTPTEAPTSISATQ

SEQ ID NO: 22380 - protein, 725 aa, Escherichia coli O83:H1; identical to SEQ ID NO: 6197
  strain NRG 857C / AIEC

SEQ ID NO: 22381 - protein, 121 aa, Escherichia coli O83:H1; identical to SEQ ID NO: 6175
  strain NRG 857C / AIEC

SEQ ID NO: 22382 - protein, 733 aa, Escherichia coli O83:H1
  strain NRG 857C / AIEC
MMISKKYTLWALNPLLLIMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAVFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 22383 - protein, 784 aa, Escherichia coli O9:H4; identical to SEQ ID NO: 6283
  strain HS

SEQ ID NO: 22384 - protein, 246 aa, Escherichia coli O9:H4; identical to SEQ ID NO: 15375
  strain HS

SEQ ID NO: 22385 - protein, 729 aa, Escherichia coli O9:H4; identical to SEQ ID NO: 12984
  strain HS

SEQ ID NO: 22386 - protein, 266 aa, Escherichia coli O9:H4; identical to SEQ ID NO: 5772
  strain HS

SEQ ID NO: 22387 - protein, 810 aa, Escherichia coli O9:H4; identical to SEQ ID NO: 6345
  strain HS

SEQ ID NO: 22388 - protein, 161 aa, Escherichia coli O9:H4; identical to SEQ ID NO: 5769
  strain HS

SEQ ID NO: 22389 - protein, 351 aa, Escherichia coli O9:H4; identical to SEQ ID NO: 7351
  strain HS

SEQ ID NO: 22390 - protein, 230 aa, Escherichia coli O9:H4; identical to SEQ ID NO: 7736
  strain HS

SEQ ID NO: 22391 - protein, 869 aa, Escherichia coli O9:H4
  strain HS
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERISLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGTVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANLQAAYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGRKPVPFGSLVRENSTGITSMVGDDGQVYLSGAPLSGELLVQWGDGANSRCIAHYVLPKQSLQQAVTVISAVCTHPGS

SEQ ID NO: 22392 - protein, 746 aa, Escherichia coli O9:H4
  strain HS
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQVLTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 22393 - protein, 193 aa, Escherichia coli O9:H4; identical to SEQ ID NO: 6300
  strain HS

SEQ ID NO: 22394 - protein, 243 aa, Escherichia coli O9:H4
  strain HS
MTFMKGLPLLLLVASLCSHAALQPDRTRIVFNANDKATSLRVDNRSDKLPYLAYSWLENEKGEKSDDLLVALPPIQRLEPKATTQVRIVKQASTAKLPGDRETLFFYNIREVPPAPEKNSDHAVLQVAIQSRIKVFWRPAALRKKAGEKVELQLQVSQQGNQLTLKNPTAYYLTIAYLGRNEKGVLPGFKTVMVAPFSTVNTNTGSYSGSQFYLGYMDDYGALRMTMLNCSGQCHLQAVEAKK

SEQ ID NO: 22395 - protein, 833 aa, Escherichia coli O9:H4
  strain HS
MAALSPPFIKYLSGMDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGILMDYNLFASSYRPQDGSSSTNLNAYGTTGINAGAWRLRSDYQLNQTDSDDNHEQSGGISRTYLFRPLPQLGSKLTLGETDFSSNIFDGFSYTGAALASDERMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVTENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 22396 - protein, 331 aa, Escherichia coli O9:H4; identical to SEQ ID NO: 6551
  strain HS

SEQ ID NO: 22397 - protein, 760 aa, Escherichia coli O9:H4; identical to SEQ ID NO: 6415
  strain HS

SEQ ID NO: 22398 - protein, 203 aa, Escherichia coli O9:H4; identical to SEQ ID NO: 6414
  strain HS

SEQ ID NO: 22399 - protein, 362 aa, Escherichia coli O9:H4; identical to SEQ ID NO: 6543
  strain HS

SEQ ID NO: 22400 - protein, 233 aa, Escherichia coli O9:H4
  strain HS
MKTCITKGIVTVSLTAILLSCSSAWAAGKGGIGLAATRLVYSEGEEQISLGVRNTSPDVSYLIQSWVMTPDNKKSADFIITPPLFVLNPANENLLRIMYIGAPLAKDRETLFFTSVRAVPSTTKREEGNTLKIATQSVIKLFWRPKGLAYPLAEAPAKLRCTSSADMVTVSNPTPYFITLTDLKIGGKVVKNQMISPFDKYQFSLPKGAKNSSVTYRTINDYGAETPQLNCKS

SEQ ID NO: 22401 - protein, 866 aa, Escherichia coli O9:H4
  strain HS
MYRTHRQHSLLSSGGVPSFIGGLVVFVSAAFNAQAETWFEPAFFKDDPSMVADLSRFEKGQKITPGVYRVDIVLNQTIVDTRNVNFVELTPEKGIAACLTTESLDAMGVNTDAFPAFKQLDKQACALLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLISYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGGSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGVQANSGIIDDDGSLYMAGLPAKGTISVRWGEAPDQICHINYELTEQQINSAITRMDAICR

SEQ ID NO: 22402 - protein, 245 aa, Escherichia coli O9:H4; identical to SEQ ID NO: 8138
  strain HS

SEQ ID NO: 22403 - protein, 511 aa, Escherichia coli O9:H4; identical to SEQ ID NO: 5749
  strain HS

SEQ ID NO: 22404 - protein, 191 aa, Escherichia coli O9:H4; identical to SEQ ID NO: 6537
  strain HS

SEQ ID NO: 22405 - protein, 232 aa, Escherichia coli O9:H4; identical to SEQ ID NO: 5747
  strain HS

SEQ ID NO: 22406 - protein, 365 aa, Escherichia coli O9:H4; identical to SEQ ID NO: 6535
  strain HS

SEQ ID NO: 22407 - protein, 729 aa, Escherichia coli O9:H4; identical to SEQ ID NO: 6531
  strain HS

SEQ ID NO: 22408 - protein, 213 aa, Escherichia coli O9:H4; identical to SEQ ID NO: 5744
  strain HS

SEQ ID NO: 22409 - protein, 565 aa, Escherichia coli O9:H4; identical to SEQ ID NO: 6395
  strain HS

SEQ ID NO: 22410 - protein, 207 aa, Escherichia coli O9:H4; identical to SEQ ID NO: 5743
  strain HS

SEQ ID NO: 22411 - protein, 551 aa, Escherichia coli O9:H4
  strain HS
MDRRRFIKGSMAMAAVCGTSGIASLFSQAAFAADSDIADGQTQRFDFSILQSMAHDLAQTAWHGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 22412 - protein, 700 aa, Escherichia coli O9:H4; identical to SEQ ID NO: 6522
  strain HS

SEQ ID NO: 22413 - protein, 340 aa, Escherichia coli O9:H4
  strain HS
MTLHRFKKIALLSVLGIAAISMNVQAAERIAFIPKLVGVGFFTSGGNGAQQAGKELGVDVTYDGPTEPSVSGQVQLINNFVNQGYNAIIVSAVSPDGLCPALKRAMQRGVRVLTWDSDTKPECRSYYINQGTPAQLGGMLVDMAARQVNKDKAKVAFFYSSPTVTEQNQWVKEAKAKIAKEHPGWEIVTTQFGYNDATKSLQTAEGILKAYSDLDAIIAPDANALPAAAQAAENLKNDKVAIVGFSTPNVMRPYVERGTVKEFGLWDVVQQGKISVYVADALLKKGSMKTGDKLDIQGVGQVEVSPNSVQGYDYEADGNGIVLLPERVIFNKENIGKYDF

SEQ ID NO: 22414 - protein, 111 aa, Escherichia coli O9:H4; identical to SEQ ID NO: 5738
  strain HS

SEQ ID NO: 22415 - protein, 118 aa, Escherichia coli O9:H4 [sequence omitted]

SEQ ID NO: 22416 - protein, 67 aa, Escherichia coli O9:H4
  strain HS
MYNNGNYHYTNKDLVKYVEVGATYYFNKNMSTYVDYKINLLDNDDDFYANNGIATDDIVAVGLVYQF

SEQ ID NO: 22417 - protein, 334 aa, Escherichia coli O9:H4
  strain HS
MKKNQFLKESDVTAESVFFMKRRQVLKALGISAAALSLPHAAHADLLSWFKGNDRPLAPAGKPLEFSKPAAWQNNLPLTPVDKVSGYNNFYEFGLDKADPAANAGSLKTDPWTLKISGEVAKPLTLDHDDLTRRFPLEERIYRMRCVEAWSMVVPWIGFPLHKLLALAEPTSNAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILDVQRQPTLLFNGYADQVASLYRGLDLRENF

SEQ ID NO: 22418 - protein, 826 aa, Escherichia coli O9:H4
  strain HS
MLRMTPLASVIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDLAAGRSHIEGASKQSDFVQAGYQYGFNNLLTLYGGSMVANNYYAFTLGAGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQKYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQSLTFGYEVNDIHGHNIGVVGQGSQLFIRTNEVPPSVNVAIDKQQGLSCTITFGKEIDESRNYICQ

SEQ ID NO: 22419 - protein, 224 aa, Escherichia coli O9:H4; identical to SEQ ID NO: 6372
  strain HS

SEQ ID NO: 22420 - protein, 663 aa, Escherichia coli O9:H4; identical to SEQ ID NO: 6307
  strain HS

SEQ ID NO: 22421 - protein, 828 aa, Escherichia coli O9:H4; identical to SEQ ID NO: 6558
  strain HS

SEQ ID NO: 22422 - protein, 162 aa, Escherichia coli O9:H4; identical to SEQ ID NO: 6365
  strain HS

SEQ ID NO: 22423 - protein, 368 aa, Escherichia coli O9:H4; identical to SEQ ID NO: 8142
  strain HS

SEQ ID NO: 22424 - protein, 200 aa, Escherichia coli O9:H4
  strain HS
MLAFCRSSLKSKKYFIILLALAAIAGLGTHAAWSSNGLPRIDNKTLARLAQQHPVVVLFRHAERCDRSTNQCLSDITGITVKGTQDARELGNAFSADIPDFDLYSSNTVRTIQSATWFSAGKKLTVDKRFLQCGNDIYSAIKDLQSKAPDKNIVIFTHNHCLTYIAKDKRDATFKPDYLNGLVMHVEKGKVYLDGEFVNH

SEQ ID NO: 22425 - protein, 274 aa, Escherichia coli O9:H4; identical to SEQ ID NO: 7777
  strain HS

SEQ ID NO: 22426 - protein, 250 aa, Escherichia coli O9:H4; identical to SEQ ID NO: 6548
  strain HS

SEQ ID NO: 22427 - protein, 880 aa, Escherichia coli O9:H4
  strain HS
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVAKNLQWSHDAKCLKSGQLEGVEIKADLSQSALVISLPQAYLEYTYPDWDPPSRWDDGISGIVADYSINAQTRHEENGGDDSNEISGNGTVGVNLGPWRMRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFTVISGQKAMAVLRLSDGSHPPFGAEVKNDNEQTVGLVDDDGNVYLAGVKPGEHMSVFWSGVAHCDINLPDPLPADLFNGLLLPCQHKGNVAPVTSPAVKPAIQEQTQRVTPTEPPTSISVNQ

SEQ ID NO: 22428 - protein, 518 aa, Escherichia coli O9:H4; identical to SEQ ID NO: 6358
  strain HS

SEQ ID NO: 22429 - protein, 432 aa, Escherichia coli O9:H4; identical to SEQ ID NO: 5727
  strain HS

SEQ ID NO: 22430 - protein, 359 aa, Escherichia coli O9:H4; identical to SEQ ID NO: 6332
  strain HS

SEQ ID NO: 22431 - protein, 686 aa, Escherichia coli O9:H4
  strain HS
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQSVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 22432 - protein, 833 aa, Escherichia coli O9:H4
  strain HS
MYKKLKLTTISELIKNIYCSLSVIIIGCASAYAVEFNKDLIEAEDRENVNLSQFETDGQLPVGKYSLSTLINNKRTPIHLDLQWVLIDNQTAVCLTPEQLTLLGFTDEIIEEAQQNLIDGCYPIEKEKQITTYLDKGKMQLSISAPQAWLKYKDANWTPPELWDHGIAGAFLDYNLYASHYAPHQGDNSQNISSYGQAGVNLGAWRLRTDYQYDQSFNNGKSQANNLDFPRIYLFRPIPEINAKLTIGQYDTESSIFDSFHFSGISLKSDENMLPPDLRGYAPQITGVAQTNAKVTVSQNNRIIYQENVPPGPFSITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLATGVGFNLNSLGSLSFDVTRSDAQLHNQNKETGYSYRANYSKRFESTGSQLTFAGYRFSDKNFVSMNEYINDTNHYTNYQNEKESYIVTFNQYLESLRLNTYVSLARNTYWDASSNVNYSLSLSRDFDIGPLKNVSTSLTFSRINWEDDNQDQLYLNISIPWGTSRTLSYGMQRNQDNNISHTASWYDSSDRNNSWSVSASGDNDEFKDMEASLRASYQHNTENGRLYLSGTSQRDSYYSLNASWNGSFTATRHGAAFHDYSGSADSRFMIDADGAEDIQLNNKRAVTNRYGIGVIPSVSSYITTSLSVDTRNLPENVDIENSVITTTLTEGAIGYAKLDTRKGYQIMGIIRLADGSHPPLGISVKDETSHKELGLVADGGFVYLNGIQDDSKITLHWGDKSCFIQPPPNSSNLTTGTVILPCIS

SEQ ID NO: 22433 - protein, 249 aa, Escherichia coli O9:H4
  strain HS
MRYLNTKNIIAAGVLLSCMNSIAWGAIIPDRTRIIMNESDKGEALKLTNQSKKLPYLAQTWIEDTKGNKSRDFIVTVPPMVRLNPNEQIQIRMITQEKIAQLPKDRETLFYFNVREIPPKTDKKNVMQVTMQHALKLFWRPKAIELEDDGVMTYEKVEIIRRNDGSIRFNNKMPYHVTLGYIGTNGVTMLPQTQSLMVLPFSHADTQFKNVPSTFQVGYINDFGGLSFYEINCPTVNNSCNVSVAKRDK

SEQ ID NO: 22434 - protein, 231 aa, Escherichia coli O9:H4; identical to SEQ ID NO: 6515
  strain HS

SEQ ID NO: 22435 - protein, 838 aa, Escherichia coli O9:H4
  strain HS
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNCYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWNYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 22436 - protein, 678 aa, Escherichia coli O9:H4
  strain HS
MVPSTFSRLKAARCLPVVLAALIFAGCGTHTPDQSTAYMQGTAQADSAFYLQQMQQSSDDTRINWQLLAIRALVKEGKTGQAVELFNQLPQELNDAQRREKTLLAVEIKLAQKDFAGAQNLLAKITPADLEQNQQARYWQAKIDASQGRPSIDLLRALIAQEPLLGAKEKQQNIDATWQALSSMTQEQANMLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITLRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPVS

SEQ ID NO: 22437 - protein, 654 aa, Escherichia coli O9:H4
  strain HS
MDCVMKGLNKITCCLLAALLMPCAGHAENEQYGANFNNADIRQFVEIVGQHLGKTILIDPSVQGTISVRSNDTFSQQEYYQFFLSILDLYGYSVITLDNGFLRVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSARIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYLQEQQQRIDGKSKALVGSEDLPVLDENTFNSHAPAPSSR

SEQ ID NO: 22438 - protein, 897 aa, Escherichia coli O9:H4; identical to SEQ ID NO: 14504
  strain HS

SEQ ID NO: 22439 - protein, 412 aa, Escherichia coli O9:H4; identical to SEQ ID NO: 14374
  strain HS

SEQ ID NO: 22440 - protein, 538 aa, Escherichia coli O9:H4; identical to SEQ ID NO: 6546
  strain HS

SEQ ID NO: 22441 - protein, 208 aa, Escherichia coli O9:H4; identical to SEQ ID NO: 5717
  strain HS

SEQ ID NO: 22442 - protein, 614 aa, Escherichia coli O9:H4; identical to SEQ ID NO: 7971
  strain HS

SEQ ID NO: 22443 - protein, 446 aa, Escherichia coli O9:H4; identical to SEQ ID NO: 6459
  strain HS

SEQ ID NO: 22444 - protein, 478 aa, Escherichia coli O9:H4
  strain HS
MTRIKINARRIFSLLIPFFFFTSVHAEQTAAPAKTVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIEIPDISTKEKAQQAIGLNMEQIKAEKQDFIKTVIPQWEEQARKNGLLSQ

SEQ ID NO: 22445 - protein, 368 aa, Escherichia coli O9:H4; identical to SEQ ID NO: 7849
  strain HS

SEQ ID NO: 22446 - protein, 241 aa, Escherichia coli O9:H4; identical to SEQ ID NO: 6134
  strain HS

SEQ ID NO: 22447 - protein, 863 aa, Escherichia coli O9:H4
  strain HS
MHIRKHRLAGFFVRLFVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNRSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPERQQQLLTQLSAECR

SEQ ID NO: 22448 - protein, 61 aa, Escherichia coli OK1180; identical to SEQ ID NO: 11399

SEQ ID NO: 22449 - protein, 998 aa, Escherichia coli OK1180; identical to SEQ ID NO: 13410

SEQ ID NO: 22450 - protein, 119 aa, Escherichia coli OK1180; identical to SEQ ID NO: 5986

SEQ ID NO: 22451 - protein, 102 aa, Escherichia coli OK1180; identical to SEQ ID NO: 6285

SEQ ID NO: 22452 - protein, 387 aa, Escherichia coli OK1180; identical to SEQ ID NO: 7356

SEQ ID NO: 22453 - protein, 118 aa, Escherichia coli OK1180 [sequence omitted]

SEQ ID NO: 22454 - protein, 360 aa, Escherichia coli OK1180; identical to SEQ ID NO: 6702

SEQ ID NO: 22455 - protein, 432 aa, Escherichia coli OK1180; identical to SEQ ID NO: 5727

SEQ ID NO: 22456 - protein, 430 aa, Escherichia coli OK1180; identical to SEQ ID NO: 5758

SEQ ID NO: 22457 - protein, 816 aa, Escherichia coli OK1180; identical to SEQ ID NO: 6462

SEQ ID NO: 22458 - protein, 243 aa, Escherichia coli OK1180; identical to SEQ ID NO: 6463

SEQ ID NO: 22459 - protein, 193 aa, Escherichia coli OK1180; identical to SEQ ID NO: 7864

SEQ ID NO: 22460 - protein, 746 aa, Escherichia coli OK1180; identical to SEQ ID NO: 6296

SEQ ID NO: 22461 - protein, 684 aa, Escherichia coli OK1180
MMMTARGTVDPSRWDEGIPALLLDYSFSGSNGRNEGTGSSSDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYNALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 22462 - protein, 207 aa, Escherichia coli OK1180; identical to SEQ ID NO: 5743

SEQ ID NO: 22463 - protein, 565 aa, Escherichia coli OK1180; identical to SEQ ID NO: 6492

SEQ ID NO: 22464 - protein, 377 aa, Escherichia coli OK1180
MLQALAEQEKLNLVVSPDVSGTVSLHLTDVPWKQALQTVVKSAGLITRQEDNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 22465 - protein, 686 aa, Escherichia coli OK1180; identical to SEQ ID NO: 6453

SEQ ID NO: 22466 - protein, 834 aa, Escherichia coli OK1180; identical to SEQ ID NO: 7903

SEQ ID NO: 22467 - protein, 125 aa, Escherichia coli OK1180; identical to SEQ ID NO: 7904

SEQ ID NO: 22468 - protein, 231 aa, Escherichia coli OK1180; identical to SEQ ID NO: 6351

SEQ ID NO: 22469 - protein, 838 aa, Escherichia coli OK1180; identical to SEQ ID NO: 7363

SEQ ID NO: 22470 - protein, 678 aa, Escherichia coli OK1180; identical to SEQ ID NO: 6353

SEQ ID NO: 22471 - protein, 512 aa, Escherichia coli OK1180; identical to SEQ ID NO: 5697

SEQ ID NO: 22472 - protein, 351 aa, Escherichia coli OK1180; identical to SEQ ID NO: 6367

SEQ ID NO: 22473 - protein, 221 aa, Escherichia coli OK1180; identical to SEQ ID NO: 7859

SEQ ID NO: 22474 - protein, 869 aa, Escherichia coli OK1180; identical to SEQ ID NO: 7862

SEQ ID NO: 22475 - protein, 230 aa, Escherichia coli OK1180; identical to SEQ ID NO: 7861

SEQ ID NO: 22476 - protein, 700 aa, Escherichia coli OK1180; identical to SEQ ID NO: 13443

SEQ ID NO: 22477 - protein, 551 aa, Escherichia coli OK1180; identical to SEQ ID NO: 5742

SEQ ID NO: 22478 - protein, 405 aa, Escherichia coli OK1180
MTERELSIIRALGEEFSTVLADLQRTFEGKMASQAQAFEEKLASLSAVLQKHVTVDEVHPVLQAMVDDAVGTIPVPRDGRDYDPDVLQQAVNDAVANIPQPADGKSLTPDDVRPMLEQMVKEAVSHIPAPRDGRDYDPEVLKQAVNDAVANIPQPADGKSLTPDDVRPMLEQMVKEAVSHIPAPRDGRDYDPEVLKQAVNDAVANIPVPADGKSITPDDVRPMLEQMVKEAVSHIPVPRDGRDYDPDVLQKAVLDAVRALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGG

SEQ ID NO: 22479 - protein, 243 aa, Escherichia coli OK1180; identical to SEQ ID NO: 6145

SEQ ID NO: 22480 - protein, 208 aa, Escherichia coli OK1180; identical to SEQ ID NO: 5717

SEQ ID NO: 22481 - protein, 614 aa, Escherichia coli OK1180; identical to SEQ ID NO: 7913

SEQ ID NO: 22482 - protein, 446 aa, Escherichia coli OK1180; identical to SEQ ID NO: 6459

SEQ ID NO: 22483 - protein, 376 aa, Escherichia coli OK1180
MAVKISGVLKDGTGKPVENCTIQLKARRTSSTVVVNTVASENPDEAGRYSMDVEYGQYSVILLVEGFPPSHAGTITVYEDSRPGTLNDFLGAMTEGDVRPEALRRFELMVEEVARHAEEAKKNAGEAETSARNAGISASQAEESAANADTSAGEASESARQAAESAAAAKQSEDASSSSASAAAQKASESSQSAAEAELSKKTAESAAGNAARDATTATEKARESAESAQSAEQSRIAAEEAVNRIPTVVGPPGPKGEQGPAGPQGPKGDKGERGDTGPVGATGERGPAGNAGPAGPQGPKGDRGERGERGETGLTGNAGPQGPKGDTGGSRPGRPTGTERRNRCGWPGGGNRTSGAEGRPGGDANTVPSGAGKHY

SEQ ID NO: 22484 - protein, 518 aa, Escherichia coli OK1180; identical to SEQ ID NO: 6358

SEQ ID NO: 22485 - protein, 89 aa, Escherichia coli OK1180; identical to SEQ ID NO: 6233

SEQ ID NO: 22486 - protein, 862 aa, Escherichia coli OK1180; identical to SEQ ID NO: 7897

SEQ ID NO: 22487 - protein, 250 aa, Escherichia coli OK1180; identical to SEQ ID NO: 7896

SEQ ID NO: 22488 - protein, 274 aa, Escherichia coli OK1180; identical to SEQ ID NO: 7895

SEQ ID NO: 22489 - protein, 192 aa, Escherichia coli OK1180; identical to SEQ ID NO: 7894

SEQ ID NO: 22490 - protein, 363 aa, Escherichia coli OK1180; identical to SEQ ID NO: 7893

SEQ ID NO: 22491 - protein, 162 aa, Escherichia coli OK1180; identical to SEQ ID NO: 5896

SEQ ID NO: 22492 - protein, 828 aa, Escherichia coli OK1180; identical to SEQ ID NO: 7891

SEQ ID NO: 22493 - protein, 641 aa, Escherichia coli OK1180; identical to SEQ ID NO: 7667

SEQ ID NO: 22494 - protein, 224 aa, Escherichia coli OK1180; identical to SEQ ID NO: 6435

SEQ ID NO: 22495 - protein, 823 aa, Escherichia coli OK1180; identical to SEQ ID NO: 7888

SEQ ID NO: 22496 - protein, 368 aa, Escherichia coli OK1180; identical to SEQ ID NO: 7849

SEQ ID NO: 22497 - protein, 216 aa, Escherichia coli OK1180
MAMMVAGRAEAGVALGATRVIYPAGQKQVQLAVTNNDENSTYLIQSWVENADDVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGARVLENALVPPMGESTVKLPSDAGSNITYRTINDYGALTPKMTGVME

SEQ ID NO: 22498 - protein, 236 aa, Escherichia coli OK1180; identical to SEQ ID NO: 6472

SEQ ID NO: 22499 - protein, 784 aa, Escherichia coli OK1180; identical to SEQ ID NO: 7852

SEQ ID NO: 22500 - protein, 170 aa, Escherichia coli OK1180 [sequence omitted]

SEQ ID NO: 22501 - protein, 866 aa, Escherichia coli OK1180; identical to SEQ ID NO: 13413

SEQ ID NO: 22502 - protein, 246 aa, Escherichia coli OK1180; identical to SEQ ID NO: 6342

SEQ ID NO: 22503 - protein, 747 aa, Escherichia coli OK1180; identical to SEQ ID NO: 6343

SEQ ID NO: 22504 - protein, 266 aa, Escherichia coli OK1180; identical to SEQ ID NO: 5772

SEQ ID NO: 22505 - protein, 161 aa, Escherichia coli OK1180; identical to SEQ ID NO: 5769

SEQ ID NO: 22506 - protein, 213 aa, Escherichia coli OK1180; identical to SEQ ID NO: 5744

SEQ ID NO: 22507 - protein, 729 aa, Escherichia coli OK1180; identical to SEQ ID NO: 7878

SEQ ID NO: 22508 - protein, 232 aa, Escherichia coli OK1180; identical to SEQ ID NO: 5747

SEQ ID NO: 22509 - protein, 191 aa, Escherichia coli OK1180; identical to SEQ ID NO: 5748

SEQ ID NO: 22510 - protein, 732 aa, Escherichia coli OK1180; identical to SEQ ID NO: 8819

SEQ ID NO: 22511 - protein, 696 aa, Escherichia coli OK1180; identical to SEQ ID NO: 6320

SEQ ID NO: 22512 - protein, 128 aa, Escherichia coli OK1180; identical to SEQ ID NO: 7871

SEQ ID NO: 22513 - protein, 591 aa, Escherichia coli OK1180; identical to SEQ ID NO: 7870

SEQ ID NO: 22514 - protein, 224 aa, Escherichia coli OK1180; identical to SEQ ID NO: 7869

SEQ ID NO: 22515 - protein, 361 aa, Escherichia coli OK1180; identical to SEQ ID NO: 7868

SEQ ID NO: 22516 - protein, 203 aa, Escherichia coli OK1180; identical to SEQ ID NO: 6414

SEQ ID NO: 22517 - protein, 733 aa, Escherichia coli OK1180
MAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGVNANGQTDTFAIYAFDTLQITRDFELNGGIRLDNYHTEYDSATACGGSGRGAITCPTGVAKGSPVTTVDTAKSGNLVNWKAGALYHLTENGNVYINYAVSQQPPGGNNFALAQSGSGNSVNRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 22518 - protein, 331 aa, Escherichia coli OK1180; identical to SEQ ID NO: 6456

SEQ ID NO: 22519 - protein, 367 aa, Escherichia coli OK1357
MRGEDIVIPGVATVVERLLNNGKALSNRQAKNDPMPPFNITQKVSEDSNDFSFSSVTNSSILEDVSLIAYPETNSILVKGNDQQIQIIRDIITQLDVAKRHIELSLWIIDIDKSELNNLGVNWQGTASFGDSFGASFNMSSSASISTLDGNKFIASVMALNQKKKANVVSRPVILTQENIPAIFDNNRTFYVSLVGERNSSLEHVTYGTLINVIPRFSSRGQIEMSLTIEDGTGNSQSNYNYNNENTSVLPEVGRTKISTIARVPQGKSLLIGGYTHETNSNEIVSIPFLSSIPVIGNVFKYKTSNISNIVRVFLIQPREIKESSYYNTAEYKSLISEREIQKTTQIIPSETTLLEDEKSLVSYLNY

SEQ ID NO: 22520 - protein, 365 aa, Escherichia coli OK1357
MALSAVAASVLMAMSAQAAEIYNKDGNKLDLYGKVNAEHYFSSSASDDGDKTYARLGFKGETQINDQLTGFGQWEYEFKGNRTESEGSDKDKTRLAFAGLRFADYGSIDYGRNYGVAYDIGAWTDVLPEFGGDTWTQTDVFMTQRATGVATYRNNDFFGLVDGLNFALQYQGKNDSAAKVNNWKGRDVVESNGDGFGLSATYDYEGFGVGATYAKSDRTDGQVSYAKKDPLNASGKTAEVWATGLKYDANNIYLAATYSETQNMTVFGDDFIANKAKNFEAVAQYQFDFGLRPSIAYLHSRGENIGAFGSQDLVEYIDLGATYYFNKNMSAFVDYKINLIDESEFTKRSEVATDNIVAVGMTYQF

SEQ ID NO: 22521 - protein, 118 aa, Escherichia coli OK1357 [sequence omitted]

SEQ ID NO: 22522 - protein, 111 aa, Escherichia coli OK1357; identical to SEQ ID NO: 7885

SEQ ID NO: 22523 - protein, 236 aa, Escherichia coli OK1357; identical to SEQ ID NO: 6472

SEQ ID NO: 22524 - protein, 883 aa, Escherichia coli OK1357
MTAIRAAFKAYRMHQVLIMPRFARLTIALGLATAVFPVDAEYYFNPRFLSNDLAESVDLSAFTKGREAPPGTYRVDIYLNDEFMTSRDITFIADDNNAELIPCLSTDLLVSLGIKKSALLDNKEHSAEKHVPDNSACTPLQDRLADASTEFDVGQQHLSLSVPQIYVGRMARGYVSPDLWEEGINAGLLNYSFNGNSINNRSNHNAGKSNYAYLNLQSGINIGSWRLRDNSTWSYYSGSSNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTIDDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSVKSVYSKSFYQTGTNIQVAGYRYSTQGFYNLSDSAYSRMSGYTVKPPTGDTNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNVGYSRNGDSSQIYYGMSGGIIAHADGITFGQPLGDTMVLVKAPGADNVKIENQTGIHTDWRGYAILPFATEYRENRVALSANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPEVSPGTLLNQQTAICR

SEQ ID NO: 22525 - protein, 646 aa, Escherichia coli OK1357
MRLATPRINLSESLTGVPGLQVQNRQNYAQDLQLSIRGFGSRSTYGIRGICLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 22526 - protein, 539 aa, Escherichia coli OK1357
MAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYADDRVMS

SEQ ID NO: 22527 - protein, 207 aa, Escherichia coli OK1357; identical to SEQ ID NO: 5743

SEQ ID NO: 22528 - protein, 565 aa, Escherichia coli OK1357
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSTTTQPSTKEAQPTP

SEQ ID NO: 22529 - protein, 210 aa, Escherichia coli OK1357; identical to SEQ ID NO: 8964

SEQ ID NO: 22530 - protein, 729 aa, Escherichia coli OK1357; identical to SEQ ID NO: 6336

SEQ ID NO: 22531 - protein, 232 aa, Escherichia coli OK1357; identical to SEQ ID NO: 5747

SEQ ID NO: 22532 - protein, 191 aa, Escherichia coli OK1357; identical to SEQ ID NO: 5748

SEQ ID NO: 22533 - protein, 505 aa, Escherichia coli OK1357; identical to SEQ ID NO: 7939

SEQ ID NO: 22534 - protein, 128 aa, Escherichia coli OK1357; identical to SEQ ID NO: 13286

SEQ ID NO: 22535 - protein, 505 aa, Escherichia coli OK1357
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQ

SEQ ID NO: 22536 - protein, 224 aa, Escherichia coli OK1357; identical to SEQ ID NO: 7869

SEQ ID NO: 22537 - protein, 361 aa, Escherichia coli OK1357
MKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSGDTVAVGIVYQF

SEQ ID NO: 22538 - protein, 760 aa, Escherichia coli OK1357
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 22539 - protein, 331 aa, Escherichia coli OK1357; identical to SEQ ID NO: 6456

SEQ ID NO: 22540 - protein, 430 aa, Escherichia coli OK1357; identical to SEQ ID NO: 5758

SEQ ID NO: 22541 - protein, 819 aa, Escherichia coli OK1357
MDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 22542 - protein, 240 aa, Escherichia coli OK1357; identical to SEQ ID NO: 7928

SEQ ID NO: 22543 - protein, 193 aa, Escherichia coli OK1357; identical to SEQ ID NO: 6300

SEQ ID NO: 22544 - protein, 746 aa, Escherichia coli OK1357; identical to SEQ ID NO: 7355

SEQ ID NO: 22545 - protein, 869 aa, Escherichia coli OK1357
MKIPTTTDIPQRYTWCLAGICYSSLAILPSFLSYAESYFNPAFLLENGTSVADLSRFERGNHQPARVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSEFSGINIGPWRLRNNGSWNYFRGNGYHSEQWNNIGTWVQRAIIPLKSELVMGDGNTGSDIFDGVGFRGIRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGTVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQYDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 22546 - protein, 230 aa, Escherichia coli OK1357; identical to SEQ ID NO: 6294

SEQ ID NO: 22547 - protein, 518 aa, Escherichia coli OK1357
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKETKFPELSWKVDDKKGSAELMEDVIEGKLDYTIADSVAISLFQRVHPELAVALDITDEQPVTWFSPLDGDDTLSAALLDFFNEMNEDGTLARIEEKYLGHGDDFDYVDTRTFLRAVDAVLPQLKPLFEKYAEEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 22548 - protein, 881 aa, Escherichia coli OK1357
MPDHSLFRLRILPWCIALAMSGSYSSVWAEDDIQFDSRFLELKGDTKIDLKRFSSQGYVEPGKYNLQVQLNKQPLAEEYDIYWYAGEDDASKSYACLTPELVAQFGLKEDVANNLQWSHDAKCLKSGQLEGMEIKADLSQSALVISLPQAYLEYTYPDWDPPSRWDDGISGIVADYSINAQTRHEENGGDDSNEISGNGTVGVNLGPWRMRADWQTNYQHTRSNDDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNQADKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 22549 - protein, 227 aa, Escherichia coli OK1357; identical to SEQ ID NO: 14274

SEQ ID NO: 22550 - protein, 274 aa, Escherichia coli OK1357; identical to SEQ ID NO: 9114

SEQ ID NO: 22551 - protein, 200 aa, Escherichia coli OK1357; identical to SEQ ID NO: 6311

SEQ ID NO: 22552 - protein, 367 aa, Escherichia coli OK1357; identical to SEQ ID NO: 6310

SEQ ID NO: 22553 - protein, 162 aa, Escherichia coli OK1357; identical to SEQ ID NO: 5896

SEQ ID NO: 22554 - protein, 828 aa, Escherichia coli OK1357; identical to SEQ ID NO: 7891

SEQ ID NO: 22555 - protein, 631 aa, Escherichia coli OK1357
MVVTASSVEQNLKDAPASISIITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNAVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 22556 - protein, 121 aa, Escherichia coli OK1357; identical to SEQ ID NO: 6175

SEQ ID NO: 22557 - protein, 826 aa, Escherichia coli OK1357; identical to SEQ ID NO: 7342

SEQ ID NO: 22558 - protein, 224 aa, Escherichia coli OK1357; identical to SEQ ID NO: 6302

SEQ ID NO: 22559 - protein, 432 aa, Escherichia coli OK1357; identical to SEQ ID NO: 5727

SEQ ID NO: 22560 - protein, 360 aa, Escherichia coli OK1357; identical to SEQ ID NO: 6702

SEQ ID NO: 22561 - protein, 686 aa, Escherichia coli OK1357
MFWRDITLSVWRKKTTGLKTKKRLLPLVLAAALCSSPVQAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 22562 - protein, 834 aa, Escherichia coli OK1357; identical to SEQ ID NO: 8715

SEQ ID NO: 22563 - protein, 231 aa, Escherichia coli OK1357
MSSIAWGAIIPDRTRIIMNESDKGEALKLTNQSKNLPYLAQTWIEDTKGNKSRDFIVTVPPMVRLNPSEQIQIRMISQEKIAQLPNDRETLFYFNVRETPPKTDKKNVMQVTMQHALKLFWRPKAIELEDDGVMSYEKVEIIRRNDGSIRFNNKMPYHVTLGYIGTNGITMLPQTQSLMVTPYSHADTQFKNVPSAFQVGYINDFGGLSFYEINCPTVNNSCNVSVAKRDK

SEQ ID NO: 22564 - protein, 231 aa, Escherichia coli OK1357; identical to SEQ ID NO: 6351

SEQ ID NO: 22565 - protein, 838 aa, Escherichia coli OK1357; identical to SEQ ID NO: 7363

SEQ ID NO: 22566 - protein, 678 aa, Escherichia coli OK1357
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPAPVSTPAATTTAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGATLYASSRSAQGSAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 22567 - protein, 386 aa, Escherichia coli OK1357; identical to SEQ ID NO: 7993

SEQ ID NO: 22568 - protein, 198 aa, Escherichia coli OK1357; identical to SEQ ID NO: 8853

SEQ ID NO: 22569 - protein, 208 aa, Escherichia coli OK1357; identical to SEQ ID NO: 5717

SEQ ID NO: 22570 - protein, 614 aa, Escherichia coli OK1357; identical to SEQ ID NO: 7971

SEQ ID NO: 22571 - protein, 446 aa, Escherichia coli OK1357; identical to SEQ ID NO: 6459

SEQ ID NO: 22572 - protein, 237 aa, Escherichia coli OK1357; identical to SEQ ID NO: 6313

SEQ ID NO: 22573 - protein, 368 aa, Escherichia coli OK1357; identical to SEQ ID NO: 7974

SEQ ID NO: 22574 - protein, 216 aa, Escherichia coli OK1357; identical to SEQ ID NO: 8786

SEQ ID NO: 22575 - protein, 863 aa, Escherichia coli OK1357
MHIRKHRLAGFFVRLVVACAFAAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNNGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 22576 - protein, 784 aa, Escherichia coli OK1357; identical to SEQ ID NO: 6283

SEQ ID NO: 22577 - protein, 170 aa, Escherichia coli OK1357 [sequence omitted]

SEQ ID NO: 22578 - protein, 866 aa, Escherichia coli OK1357; identical to SEQ ID NO: 7345

SEQ ID NO: 22579 - protein, 230 aa, Escherichia coli OK1357; identical to SEQ ID NO: 7855

SEQ ID NO: 22580 - protein, 747 aa, Escherichia coli OK1357; identical to SEQ ID NO: 6343

SEQ ID NO: 22581 - protein, 266 aa, Escherichia coli OK1357; identical to SEQ ID NO: 5772

SEQ ID NO: 22582 - protein, 161 aa, Escherichia coli OK1357; identical to SEQ ID NO: 5769

SEQ ID NO: 22583 - protein, 221 aa, Escherichia coli OK1357; identical to SEQ ID NO: 8014

SEQ ID NO: 22584 - protein, 351 aa, Escherichia coli OK1357; identical to SEQ ID NO: 5767

SEQ ID NO: 22585 - protein, 82 aa, Escherichia coli OK1357
MFSGIANGASRVTLTQNGRLLHSEMVPAGPFSITDVPLYTSVDVTMKITGEDGREQTQLFPLSVMAGQLNPTTRVQRGSRFV

SEQ ID NO: 22586 - protein, 174 aa, Escherichia coli OK1357
MHNVSTTTTGFPLAKILASTELGDNTIQAANDAANKLFSLAIADLTANKNINTTNAHSTSNILIPELKAPKSLNASSQLTLLIGNLIQILGEKSLTALTNKITAWKSQQQARQQKNLEFSDKINTLLSETEGLTRDYEKQINKLKNADSKIKDLENKINQIQTRLSELDPDSPE

SEQ ID NO: 22587 - protein, 203 aa, Escherichia coli OK1357; identical to SEQ ID NO: 6414

SEQ ID NO: 22588 - protein, 862 aa, Escherichia coli OR:K5:H-; identical to SEQ ID NO: 6838
  strain ABU 83972

SEQ ID NO: 22589 - protein, 246 aa, Escherichia coli OR:K5:H-; identical to SEQ ID NO: 5857
  strain ABU 83972

SEQ ID NO: 22590 - protein, 752 aa, Escherichia coli OR:K5:H-; identical to SEQ ID NO: 8199
  strain ABU 83972

SEQ ID NO: 22591 - protein, 266 aa, Escherichia coli OR:K5:H-; identical to SEQ ID NO: 6841
  strain ABU 83972

SEQ ID NO: 22592 - protein, 203 aa, Escherichia coli OR:K5:H-; identical to SEQ ID NO: 7450
  strain ABU 83972

SEQ ID NO: 22593 - protein, 656 aa, Escherichia coli OR:K5:H-; identical to SEQ ID NO: 8223
  strain ABU 83972

SEQ ID NO: 22594 - protein, 565 aa, Escherichia coli OR:K5:H-; identical to SEQ ID NO: 6844
  strain ABU 83972

SEQ ID NO: 22595 - protein, 207 aa, Escherichia coli OR:K5:H-; identical to SEQ ID NO: 21814
  strain ABU 83972

SEQ ID NO: 22596 - protein, 518 aa, Escherichia coli OR:K5:H-; identical to SEQ ID NO: 8246
  strain ABU 83972

SEQ ID NO: 22597 - protein, 721 aa, Escherichia coli OR:K5:H-; identical to SEQ ID NO: 6807
  strain ABU 83972

SEQ ID NO: 22598 - protein, 351 aa, Escherichia coli OR:K5:H-; identical to SEQ ID NO: 8304
  strain ABU 83972

SEQ ID NO: 22599 - protein, 539 aa, Escherichia coli OR:K5:H-
  strain ABU 83972
MAAVCGTSGIASLFSQAAFAADSDIADGQTQRFDFSILQSMAHDLAQTAWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKNQVIMDVENHLYARKDIKQLGIAPMISMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 22600 - protein, 700 aa, Escherichia coli OR:K5:H-; identical to SEQ ID NO: 8217
  strain ABU 83972

SEQ ID NO: 22601 - protein, 883 aa, Escherichia coli OR:K5:H-; identical to SEQ ID NO: 6849
  strain ABU 83972

SEQ ID NO: 22602 - protein, 236 aa, Escherichia coli OR:K5:H-; identical to SEQ ID NO: 7624
  strain ABU 83972

SEQ ID NO: 22603 - protein, 432 aa, Escherichia coli OR:K5:H-; identical to SEQ ID NO: 5727
  strain ABU 83972

SEQ ID NO: 22604 - protein, 208 aa, Escherichia coli OR:K5:H-; identical to SEQ ID NO: 5869
  strain ABU 83972

SEQ ID NO: 22605 - protein, 102 aa, Escherichia coli OR:K5:H-; identical to SEQ ID NO: 14041
  strain ABU 83972

SEQ ID NO: 22606 - protein, 628 aa, Escherichia coli OR:K5:H-
  strain ABU 83972
MKPAASFFYCGCFTMIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGSYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 22607 - protein, 746 aa, Escherichia coli OR:K5:H-; identical to SEQ ID NO: 8192
  strain ABU 83972

SEQ ID NO: 22608 - protein, 360 aa, Escherichia coli OR:K5:H-; identical to SEQ ID NO: 8258
  strain ABU 83972

SEQ ID NO: 22609 - protein, 446 aa, Escherichia coli OR:K5:H-; identical to SEQ ID NO: 5873
  strain ABU 83972

SEQ ID NO: 22610 - protein, 193 aa, Escherichia coli OR:K5:H-; identical to SEQ ID NO: 6300
  strain ABU 83972

SEQ ID NO: 22611 - protein, 733 aa, Escherichia coli OR:K5:H-; identical to SEQ ID NO: 6152
  strain ABU 83972

SEQ ID NO: 22612 - protein, 696 aa, Escherichia coli OR:K5:H-; identical to SEQ ID NO: 6787
  strain ABU 83972

SEQ ID NO: 22613 - protein, 237 aa, Escherichia coli OR:K5:H-; identical to SEQ ID NO: 7546
  strain ABU 83972

SEQ ID NO: 22614 - protein, 478 aa, Escherichia coli OR:K5:H-; identical to SEQ ID NO: 6796
  strain ABU 83972

SEQ ID NO: 22615 - protein, 430 aa, Escherichia coli OR:K5:H-; identical to SEQ ID NO: 5758
  strain ABU 83972

SEQ ID NO: 22616 - protein, 118 aa, Escherichia coli OR:K5:H- [sequence omitted]

SEQ ID NO: 22617 - protein, 686 aa, Escherichia coli OR:K5:H-; identical to SEQ ID NO: 6795
  strain ABU 83972

SEQ ID NO: 22618 - protein, 331 aa, Escherichia coli OR:K5:H-; identical to SEQ ID NO: 8190
  strain ABU 83972

SEQ ID NO: 22619 - protein, 760 aa, Escherichia coli OR:K5:H-; identical to SEQ ID NO: 6793
  strain ABU 83972

SEQ ID NO: 22620 - protein, 360 aa, Escherichia coli OR:K5:H-; identical to SEQ ID NO: 5891
  strain ABU 83972

SEQ ID NO: 22621 - protein, 713 aa, Escherichia coli OR:K5:H-; identical to SEQ ID NO: 6056
  strain ABU 83972

SEQ ID NO: 22622 - protein, 222 aa, Escherichia coli OR:K5:H-; identical to SEQ ID NO: 5850
  strain ABU 83972

SEQ ID NO: 22623 - protein, 840 aa, Escherichia coli OR:K5:H-; identical to SEQ ID NO: 5851
  strain ABU 83972

SEQ ID NO: 22624 - protein, 246 aa, Escherichia coli OR:K5:H-
  strain ABU 83972
MKLPLITTGMICFLGICNFAQATVSPDRTRIIFNASNKSATVRLTNQSKIDPYLAQSWIEDASGKKTRDYISTLPPMERIEPDEQVQIRLMALASLNNLPQDRETLFYYNVREIPPRAKEQNVMQIAMQSRLKLFWRPKAIELKEGEMVPLQKVTITRTAAGLTLNNPTPYHITVGYIGTNGKTLMPGADSIMVAPFASATQHLNNLPSTFQLGFVADYGGLEMFKVVCNSVQSLCQSTPAKKGKI

SEQ ID NO: 22625 - protein, 203 aa, Escherichia coli OR:K5:H-; identical to SEQ ID NO: 6414
  strain ABU 83972

SEQ ID NO: 22626 - protein, 334 aa, Escherichia coli OR:K5:H-
  strain ABU 83972
MKKNQFLKESDVTAESVFFMKRRQVLKALGISAAAFSLPHAAHADLLSWFKGNDRPPAPAGKPLEFSKPAAWQNNLPLTPADKVSGYNNFYEFGLDKADPAANAGSLKTDPWTLKISGEVAKPLTLDHDDLTRRFPLEERIYRMRCVEAWSMVVPWIGFPLHKLLALAEPTSDAKYVAFETIYAPEQMPGQQDRFIGGGLKYPYVEGLRLDEAMHPLTLMTVGVYGKALPPQNGAPVRLIVPWKYGFKGIKSIVSIKLTRERPPTTWNLAAPDEYGFYANVNPHVDHPRWSQATERFIGSGGILDVQRQPTLLFNGYADQVASLYRGLDLRENF

SEQ ID NO: 22627 - protein, 643 aa, Escherichia coli OR:K5:H-; identical to SEQ ID NO: 8211
  strain ABU 83972

SEQ ID NO: 22628 - protein, 678 aa, Escherichia coli OR:K5:H-; identical to SEQ ID NO: 7525
  strain ABU 83972

SEQ ID NO: 22629 - protein, 244 aa, Escherichia coli OR:K5:H-; identical to SEQ ID NO: 6111
  strain ABU 83972

SEQ ID NO: 22630 - protein, 836 aa, Escherichia coli OR:K5:H-; identical to SEQ ID NO: 6074
  strain ABU 83972

SEQ ID NO: 22631 - protein, 844 aa, Escherichia coli OR:K5:H-
  strain ABU 83972
MNANNLSCLIYCRCSLLLFAALGLTVTNHSFAAEEAEFDSEFLHLDKGINVIDIRRFSHGNPVPEGRYYSDIYVNNVWKGKADLQYLRTANTGAPTLCLTPELLSLIDLVKDTMSGNTSCFPASTGLSSASINFDLSTLRLNIEIPQALLNTRPRGYISPAQWQSGVPAAFINYDANYYQYNSSGTSNEQTYLGLKAGFNLWGWALRHRGSESWNNSYPAGYQNIETSIMHDLAPLRAQFTLGDFYTNGELMDSLSLRGVRLASDERMLPGSLRGYAPAVRGIANSNAKVTIYQNAHILYETTVPAGPFVINDLYPSGYAGDLIVKITESNGQTRMFTVPFAAVAQLIRPGFSRWQMSVGKYRYANKTYNDLIAQGTYQYGLTNDITLNSGLTTASGYTAGLAGLAFNTPLGAIASDITLSRTAFRYSGVTRKGYSLHSSYSINIPASNTNITLAAYRYSSKDFYHLKDALSANHNAFIDDVSVKSTAFYRPRNQFQISINQELGEKWGGMYLTGTTYNYWGHKGSRNEYQMGYSNFWKQLGYQIGLSQSRDNEQQRRDDRFYINFTLPLGGSVQSPVFSTVLNYSKEEKNSIQTSISGTGGEDNQFSYGISGNSQENGPSGYAMNGGYRSPYVNITTTVGHDTQNNNQRSFSASGAVVAHPYGVTLSNDLSDTFAIIHAEGAQGAVINNASGSRLDFWGNGIVPYVTPYEKNQISIDPSNLDLNVELSATEQEIIPRANSATLVKFDTKTGRSLLFDIRMSTGNPPPMASEVLDEHGQLAGYVAQAGKVFTRGLPEKGHLSVVWGPDNKDRCSFVYHVAHNKDDMQSQLVPVLCIQHPNQEKT

SEQ ID NO: 22632 - protein, 241 aa, Escherichia coli OR:K5:H-; identical to SEQ ID NO: 8229
  strain ABU 83972

SEQ ID NO: 22633 - protein, 865 aa, Escherichia coli OR:K5:H-; identical to SEQ ID NO: 8207
  strain ABU 83972

SEQ ID NO: 22634 - protein, 138 aa, Escherichia coli OR:K5:H-; identical to SEQ ID NO: 8206
  strain ABU 83972

SEQ ID NO: 22635 - protein, 774 aa, Escherichia coli OR:K5:H-; identical to SEQ ID NO: 8205
  strain ABU 83972

SEQ ID NO: 22636 - protein, 362 aa, Escherichia coli OR:K5:H-; identical to SEQ ID NO: 5874
  strain ABU 83972

SEQ ID NO: 22637 - protein, 715 aa, Escherichia coli OR:K5:H-; identical to SEQ ID NO: 6806
  strain ABU 83972

SEQ ID NO: 22638 - protein, 368 aa, Escherichia coli OR:K5:H-; identical to SEQ ID NO: 8204
  strain ABU 83972

SEQ ID NO: 22639 - protein, 840 aa, Escherichia coli OR:K5:H-; identical to SEQ ID NO: 5645
  strain ABU 83972

SEQ ID NO: 22640 - protein, 231 aa, Escherichia coli OR:K5:H-; identical to SEQ ID NO: 6154
  strain ABU 83972

SEQ ID NO: 22641 - protein, 478 aa, Escherichia coli OR:K5:H-; identical to SEQ ID NO: 8255
  strain ABU 83972

SEQ ID NO: 22642 - protein, 826 aa, Escherichia coli OR:K5:H-
  strain ABU 83972
MLRMTPLASAIVALLIGIEAYAAEETFDTHFMIGGMKDQQVSNIRLEDNQPLPGPYDIDIYVNKQWRGKYEIIVKDNPQETCLSREMIKRLGINTDSFASGKQCLTFKQLIQGGSYTWDIGVFRLDFSVPQAWVEDLESGYVPPENWERGINAFYTSYYVSQYYSDYKASGNSKSTYVRFNSGLNLQGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSIQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSNKDYQLSYSNNLRRISYTLAASHAYDENHHEEKRFNIFISIPFDWGDDVTTPRRQIYMSNSTTFDDQGVASNNTGLSGTVGSRDQFNYGVNLSYQYQGNETTAGANLTWNAPVATVNGSYSQSSAYRQAGASVSGGIVAWSGGVNLANRLSETFAVMNAPGIKDAYVNGQKYRTTNRNGVVVYDGMTPYRENYLMLDVSQSDSEAELRGNRKIAAPYRGAVVLVNFDTDQRKPWFIKALRADGQPLTFGYEVNDIHGHNIGVVGQGSQLFIRTNEVPPSVNVAIDKQQGLSCTITFGKEIDESRNYICQ

SEQ ID NO: 22643 - protein, 224 aa, Escherichia coli OR:K5:H-; identical to SEQ ID NO: 5893
  strain ABU 83972

SEQ ID NO: 22644 - protein, 650 aa, Escherichia coli OR:K5:H-; identical to SEQ ID NO: 21371
  strain ABU 83972

SEQ ID NO: 22645 - protein, 900 aa, Escherichia coli OR:K5:H-; identical to SEQ ID NO: 6827
  strain ABU 83972

SEQ ID NO: 22646 - protein, 407 aa, Escherichia coli OR:K5:H-; identical to SEQ ID NO: 22041
  strain ABU 83972

SEQ ID NO: 22647 - protein, 725 aa, Escherichia coli OR:K5:H-; identical to SEQ ID NO: 8253
  strain ABU 83972

SEQ ID NO: 22648 - protein, 663 aa, Escherichia coli OR:K5:H-; identical to SEQ ID NO: 5894
  strain ABU 83972

SEQ ID NO: 22649 - protein, 377 aa, Escherichia coli OR:K5:H-
  strain ABU 83972
MLQALAEQEKLNLVVSPDVSGTVSLHLTDVPWKQALQTVVKSAGLITRQEGNILSVHSVAWQNDNIARQEAEQARAQANLPLENRNITLQYADAGELAKAGEKLLSAKGSMTVDKRTNRLLLRDNKTALSTLEQWVSQMDLPVGQVELSAHIVTINEKSLRELGVKWTLADAQQAGGVGQVTTLGSDLSVATATTHIGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 22650 - protein, 229 aa, Escherichia coli OR:K5:H-
  strain ABU 83972
MIGGTRFAYPENQSSISVELKNTSDRDMLVKVAVSPDDARQLTGTVESLPSYSETVFIATPPLFILKPDKNTKIRINRVGGSLPADRESLFILNVAALPTLENSHSVKTDNQLQIAVRNRMKIFYRPSNLSEDPNMSYQKLRWARKNEIVTVYNPGPRYVTLYNLHVDGKVIDGGMVAPFSHRQQSWCKSQGVCEIAWQTLDIYNNVLPILKVKLNPSQLDVTGFAFSQ

SEQ ID NO: 22651 - protein, 656 aa, Escherichia coli OR:K5:H-; identical to SEQ ID NO: 6178
  strain ABU 83972

SEQ ID NO: 22652 - protein, 517 aa, Escherichia coli OR:K5:H-; identical to SEQ ID NO: 6817
  strain ABU 83972

SEQ ID NO: 22653 - protein, 191 aa, Escherichia coli OR:K5:H-; identical to SEQ ID NO: 6818
  strain ABU 83972

SEQ ID NO: 22654 - protein, 232 aa, Escherichia coli OR:K5:H-; identical to SEQ ID NO: 19098
  strain ABU 83972

SEQ ID NO: 22655 - protein, 828 aa, Escherichia coli OR:K5:H-; identical to SEQ ID NO: 6558
  strain ABU 83972

SEQ ID NO: 22656 - protein, 162 aa, Escherichia coli OR:K5:H-; identical to SEQ ID NO: 5896
  strain ABU 83972

SEQ ID NO: 22657 - protein, 375 aa, Escherichia coli OR:K5:H-; identical to SEQ ID NO: 5922
  strain ABU 83972

SEQ ID NO: 22658 - protein, 200 aa, Escherichia coli OR:K5:H-; identical to SEQ ID NO: 5898
  strain ABU 83972

SEQ ID NO: 22659 - protein, 250 aa, Escherichia coli OR:K5:H-; identical to SEQ ID NO: 5862
  strain ABU 83972

SEQ ID NO: 22660 - protein, 784 aa, Escherichia coli OR:K5:H-; identical to SEQ ID NO: 6829
  strain ABU 83972

SEQ ID NO: 22661 - protein, 365 aa, Escherichia coli OR:K5:H-; identical to SEQ ID NO: 7453
  strain ABU 83972

SEQ ID NO: 22662 - protein, 729 aa, Escherichia coli OR:K5:H-; identical to SEQ ID NO: 6821
  strain ABU 83972

SEQ ID NO: 22663 - protein, 213 aa, Escherichia coli OR:K5:H-; identical to SEQ ID NO: 5744
  strain ABU 83972

SEQ ID NO: 22664 - protein, 274 aa, Escherichia coli OR:K5:H-; identical to SEQ ID NO: 5899
  strain ABU 83972

SEQ ID NO: 22665 - protein, 250 aa, Escherichia coli OR:K5:H-; identical to SEQ ID NO: 6150
  strain ABU 83972

SEQ ID NO: 22666 - protein, 884 aa, Escherichia coli OR:K5:H-; identical to SEQ ID NO: 6149
  strain ABU 83972

SEQ ID NO: 22667 - protein, 660 aa, Escherichia coli OR:K5:H-; identical to SEQ ID NO: 6837
  strain ABU 83972

SEQ ID NO: 22668 - protein, 170 aa, Escherichia coli OR:K5:H-; identical to SEQ ID NO: 5855
  strain ABU 83972

SEQ ID NO: 22669 - protein, 360 aa, Escherichia coli OR:K5:H-; identical to SEQ ID NO: 5879
  strain ABU 83972

SEQ ID NO: 22670 - protein, 816 aa, Escherichia coli PCN033
MLRTTRWVAAIIFLYSFPGYAEETFDTHFMIGGMRGEKVSEYRFDNKQPLPGNYELDFYVNHQWRGKKDITIPESPAKPCLPKVLLTTLGVKTDNLNTEDNCILLDEAVHGGQYQWDISEHRLNLTVPQAYINELERGYVPPESWDRGIDAFYTSYNLSQYRSYDSNNNSNTASYGRFNSGLNLFSWQLHSDASYSKPDDMKGKWQSNTLYLERGWSQILSTVQIGENYTSSLIFDSLRFSGIRLFRDMQMLPDSMQSFTPLVQGVAQSNALITVSQNGYTIYQKEVPPGPFTIADLQLSGSGSDLDVSIKEADGSVRSFLVPYSSVPNMLQPGVSNFDFIAGRSQIYGVKNQEDFLEANYIYGLNNLLTLYGGTILSDNYNAITLGNGWNTPLGAISFDATRSSSKLNNDTRHEGTSYQVAYNKYLLQTATHFSVAAWRYASQDYRTFSDHLYENDKINHQSDYDDFYDIGRKNSLSANIMQPLSNNLGNVSLSALWRNYWGRSGNAKDYQFSYSNSWQRISYTFSASQSYDENDKEEERFNLFISIPFYWGDDIAKTRHQINLSNSTSFSKDGYSSNNTGITGIAGEHDQLNYGIYVNQQQQNNDTSLGTNLSWRTPIATIDGSYSHSKNAWQSGGSISSGLVVWPGGINITNQLSDTFAILDAPGLEGAHINGQKYNRTNSKGQVVYDLIIPHRENHLVLDIANSESETELQGNRQIIAPYRGAVSYVQFTTDQRKPWYIQALRPDGSPLTFGYDVLDLQENNIGVVGQGSRLFIRVDEIPTGIKVALNDEQNLFCTITFQHVIDENKTYICQ

SEQ ID NO: 22671 - protein, 227 aa, Escherichia coli PCN033
MRIITALLMSFFILPVHAGVVIYGTRIIYPEKNREVLVQLMNQSKNASLIQAWIDDGNTTIAPEKIQVPFILTPPVSRVAGGSGQQLKIRKMPNNLPHNKESLFYLNVLDIPPNNPQNAGKNKIKLALQNRIKLLWRPSGIAPVDKKSLSQLNIKKKNNAISINNETANWITVTTIKAQNVKVNNESILLPPFSNNDITLKNNNASEYELTVVDDYGNNIHSKIAAR

SEQ ID NO: 22672 - protein, 784 aa, Escherichia coli PCN033; identical to SEQ ID NO: 6283

SEQ ID NO: 22673 - protein, 866 aa, Escherichia coli PCN033
MNKKTTTNYHYPLTHIATFCALLYSSSALSAEHVEYDNTFLMGRDASNIDLSRYSEGNPTLPGLYDVSVYINDQPVTNQSIAFVTVEGKKNAQACLTLKNLLQFHINQPDINAANAVLLARDNELGDCLNLAELIPQTSIRYDVNDQRLDIYVPQAWVMKNYQNYVDPSLWENGINAAMLSYNVNAYHSESPDRKNDSVYAAFNGGMNLGAWRLRATGNYSWRNDSDSNYDFQNRYLQRDLASLRSQLIVGESYTTGETFDSVSIRGVRLYSDSRMLPPALASFAPIIHGVANTNAKVTITQGSYKIYETTVPPGAFVIDDLSPSGYGSDLIVTIEEADGSKRTFSQPFSSVVQMLRPGVGRWDISGGQIIKDDIQDEPNLFQASYYYGLNNYLTGYTGIQLTDNHYTAGLLGLGLNTSLGAFSFDITHSNVSIPDDKTYQGQSYRLSWNKLFENTNTSLNIAAYRYSTQNYLGLNDALTLIDEVKHPEQDLEPQTMRNYSRMKNQVTVSISQPLKFEKQDYGSFYLTGDWSDYWASGQNRSNYSIGYSNSASWGSYSISAQRSWNEDGETDDSIYLSFTIPIEKLLGTSHRDSGFQSIDTQLNSDFKGNNQLNISSSGFSDANRVSYSVNTGYTMMKASDDLSYIGGYASYESPWGTLAGSVSASSDNSRQFSLNTDGGFVLHSGGLTFSNDSFSDSDTLAVVQAPGAKGARINYGNSTVDRWGYGVTSALSPYHENRIALDISGIENDVEMKSTSAIAVPRQGSVVFADFETVQGQSAIMNIKRNDGKNIPFAADIFDEQNNMIGNVGQGGQAFVRGIEQQGNIRINWVEEGKPVACIAHYKQTADQQKLTQTIILNGISCQIQ

SEQ ID NO: 22674 - protein, 246 aa, Escherichia coli PCN033
MFFNTKHTVALCFATCLAFSSSAIADIVISGTRVIYTSDQKSVNVRLENKGNNPLLVQSWLDTGDDNAEPGSINVPFTATPPVSRIDGKRGQTIKLMYTGSSALPKDRESVFWFNVLEVPPKPDAEKMANQSMLQLAFRTRIKLFYRPEGLTGIPSDAPAALKWSWTTSGGKVALRVVNPTPFYVSFSSGDVVASGKRYPLDVKMIAPRSEDAITVNGISSKVSSAQVHFFAINDFGGAIEGNATL

SEQ ID NO: 22675 - protein, 747 aa, Escherichia coli PCN033
MARSKTAQPKHSLRKIAVVVATAVSGMSVYAQAAVEPKEDTITVTAAPASQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPDNSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 22676 - protein, 266 aa, Escherichia coli PCN033; identical to SEQ ID NO: 5772

SEQ ID NO: 22677 - protein, 161 aa, Escherichia coli PCN033; identical to SEQ ID NO: 5769

SEQ ID NO: 22678 - protein, 230 aa, Escherichia coli PCN033; identical to SEQ ID NO: 7465

SEQ ID NO: 22679 - protein, 869 aa, Escherichia coli PCN033; identical to SEQ ID NO: 8606

SEQ ID NO: 22680 - protein, 746 aa, Escherichia coli PCN033; identical to SEQ ID NO: 8052

SEQ ID NO: 22681 - protein, 193 aa, Escherichia coli PCN033; identical to SEQ ID NO: 6300

SEQ ID NO: 22682 - protein, 243 aa, Escherichia coli PCN033; identical to SEQ ID NO: 17320

SEQ ID NO: 22683 - protein, 816 aa, Escherichia coli PCN033
MNIYRLSFISCLVMAMPSALAVEFNLNVLDKSMRDRIDISLLKEKGVIAPGEYFVSVAVNNNQISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASSYRPQDGSSSTNLNAYGTAGINAGAWRLRSDYQLNKTDSEDNHDQSGGISRTYLFRPLPQLGSKLTLGETDFSSNIFDGFSYTGAALASDDRMLPWELRGYAPQISGIAQTNATVTVSHSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISGDDYHSAAMGIGQNMLWLGALSFDVTWASSQFDTQQDERGLSYRFNYSKQVDATNSTISLAAYRFSDRHFHSYANYLDHKYNDNDAQDEKQTISLSVGQPITPLNLNLYANLLHQTWWNADASTTANITAGFNVDIGNWRDISISTSFNTTHYEDKDRDNQIYLSISLPFGNGGRVGYDMQNSSQSTTHRMSWNDTLDERNSWGMSTGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVADNVIKETWIEGAIGYKSLASRSGKDVNVIIRNASGQFPPLGADIRQDDSGISVGMVGEEGHAWLSGVAENQQFTVVWGDSQRCSIHLPEHMEDTANRLILPCH

SEQ ID NO: 22684 - protein, 331 aa, Escherichia coli PCN033; identical to SEQ ID NO: 6551

SEQ ID NO: 22685 - protein, 760 aa, Escherichia coli PCN033
MENNRNFPARQFHSLTFFAGLCISITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 22686 - protein, 203 aa, Escherichia coli PCN033; identical to SEQ ID NO: 8073

SEQ ID NO: 22687 - protein, 232 aa, Escherichia coli PCN033
MVYDALGYTDMLPEFGGDTAYSDDFFVGRVGGVATYRNSNFFGLVDGLNFAVQYLGKNERAGIPERSNGDGVGGSISYEFEGFGIVGAYGAADRTDAQEAEFRGQGKKAEQWATGLKYDANNIYLAANYGETRNATPIEGGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 22688 - protein, 224 aa, Escherichia coli PCN033
MTVSLTAILLSCSFTWAAGKGGVGLAATRLVYSEGEEQISLGVRNTSPDVPYLIQSWVMTPDNKKSADFIITPPLFVLNPANENLLRIMYIGAPLAKDRETLFFTSVRAVPSTTKREEGNTLKIATQSVIKLFWRPKGLAYPLAEAPAKLRCTSSADMVTVSNPTPYFITLTDLKIGGKVVKNQMISPFDKYQFSLPKGAKNNSVTYRTINDYGAETPQLNCKS

SEQ ID NO: 22689 - protein, 851 aa, Escherichia coli PCN033
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACAPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSINSYSVPFSSVPLLQRQGRIKYAVTLAKYRTNSNDQQESKFAQATLQWGGPWGTTWYGGGQYAEYYRAAMLGLGFNLGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGDYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHTTQNLGLTETLLDDGNLSYSVQQGYNSEGETANGSASMDYKGAFADARVGYNYSDNGSQQQLNYALSGSLVAHSRGITLGQSLGETNVLIAAPGAENTRVANSTGLKTDWRGYTVVPYATSYRENRIVLDAASLKRNVDLENAVVNVVPTKGALVLAEFNAYAGGRVLMKTSTQGIPLRFGAIATLDGVQTNSGIIDDDGSLYMAGLPAKGTITVRWGEAPDQICHISYQLTEQQINAAITRMDAICR

SEQ ID NO: 22690 - protein, 229 aa, Escherichia coli PCN033
MTLAIFAVLSLLVAGELQAGVVVGGTRFIFPADRESISISLTNTSQESWLINSKINRPTRWAGGEASTGSAPLLVAPPLVLLKPGTTGTLRLLRTESDILPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAIAPCHVSWRTINDYGGLSAKKEQNLL

SEQ ID NO: 22691 - protein, 191 aa, Escherichia coli PCN033
MKKSLLGLTFASLMFSAGSAVAADYKIDKEGQHAFVNFRIQHLGYSWLYGTFKDFDGTFTFDEKNPAADKVNVTINTTSVDTNHAERDKHLRSADFLNTAKYPQATFTSTSVKKDGDDLDITGDLTLNGVTKPVTLEAKLIGQGDDPWGGKRAGFDAEGKIKLKDFNIKTDLGPASQEVDLIISVEGVQQK

SEQ ID NO: 22692 - protein, 232 aa, Escherichia coli PCN033; identical to SEQ ID NO: 5747

SEQ ID NO: 22693 - protein, 729 aa, Escherichia coli PCN033
MLSTQFNRDNQHQTTSKPSLLAACIALALLPSAAFAAPATEETVIVEGSATTPVDDENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNIDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 22694 - protein, 213 aa, Escherichia coli PCN033; identical to SEQ ID NO: 5744

SEQ ID NO: 22695 - protein, 203 aa, Escherichia coli PCN033; identical to SEQ ID NO: 6347

SEQ ID NO: 22696 - protein, 656 aa, Escherichia coli PCN033
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEANLGYRQGWSRSQDNAYDMHASFAASSDLGYLQVSGSQLKQDFLGLPHGVNNDIAGKHGKMINSSADDKRGIVKLGFTPRENDEYTLTYIKQDGEKDNPPYSGNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFANEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKITDLPTQTMTAWMTPKPWEPLSVTLSEEARSSSYSNSDGSQKAAGFAVTHIRADYTLGHGFSVNASVNNLFDTKYAYSEGFIEEGRNFWAGIEYTF

SEQ ID NO: 22697 - protein, 565 aa, Escherichia coli PCN033
MKSPTPSRPLKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWGEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPVKQNEAEPTP

SEQ ID NO: 22698 - protein, 207 aa, Escherichia coli PCN033; identical to SEQ ID NO: 5743

SEQ ID NO: 22699 - protein, 539 aa, Escherichia coli PCN033; identical to SEQ ID NO: 6525

SEQ ID NO: 22700 - protein, 672 aa, Escherichia coli PCN033
MIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLNLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGYGLLSLALFQTDTDDEIVVDSSSGGRTTYKNAGKTRRQGAELAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGMNIAWRFE

SEQ ID NO: 22701 - protein, 366 aa, Escherichia coli PCN033; identical to SEQ ID NO: 7946

SEQ ID NO: 22702 - protein, 111 aa, Escherichia coli PCN033; identical to SEQ ID NO: 5889

SEQ ID NO: 22703 - protein, 122 aa, Escherichia coli PCN033; identical to SEQ ID NO: 5737

SEQ ID NO: 22704 - protein, 826 aa, Escherichia coli PCN033
MLRMTPLASAIVALLLGIEAYAAEETFDTHFMIGAVKDQQVANIRLDDNQPLPGQYDIDIYVNKQWRGKYEIIVKDNPQETCLSREIIKRLGINTDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNSNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSYNLRQISYTLAASQAYDENHHEEKRFNIFISIPFDWGDDVTTPRRQIYMSNSTTFDDQGFASNNTGLSGTVGSRYQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPFRGAVVLVNFDTDQRKPWFIKALRTDGQPLTFGYEVNDIHGHNIGVVGQGSQLFIRTNEVPPSVNVAIDKQQGLSCTITFGKEIDESRNYICQ

SEQ ID NO: 22705 - protein, 224 aa, Escherichia coli PCN033; identical to SEQ ID NO: 17323

SEQ ID NO: 22706 - protein, 631 aa, Escherichia coli PCN033
MVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFYTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 22707 - protein, 162 aa, Escherichia coli PCN033; identical to SEQ ID NO: 8101

SEQ ID NO: 22708 - protein, 364 aa, Escherichia coli PCN033; identical to SEQ ID NO: 5776

SEQ ID NO: 22709 - protein, 518 aa, Escherichia coli PCN033; identical to SEQ ID NO: 6358

SEQ ID NO: 22710 - protein, 200 aa, Escherichia coli PCN033
MLAFCRSSLKSKKYFIILLALAAIAGLGTHAAWSSNGLPRIDNKTLARLAQQHTVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKDKRDATFKPDYLDGLVMHVEKGKVYLDGEFVNH

SEQ ID NO: 22711 - protein, 274 aa, Escherichia coli PCN033; identical to SEQ ID NO: 8643

SEQ ID NO: 22712 - protein, 249 aa, Escherichia coli PCN033
MIKHLSAKTLTTVLSLLAATVSFSAQASVTPDRTRLIFNESDKSISVTLRNNDPKLPYLAQSWIEDEKGVKISSPLAVLPPVQRIDAMMNGQVKIQGLPDIHKLPADRESMFYFNVREIPPKSNKSNTLQIALQTRIKLFWRPKALEKTTTQNPWQHKVTLTRNGQEFTVNNPTPYYVIFSNASAQKNGNPAAGFSPIVMSPKTSAPLNVKMGSVPVLTYVNDYGARMPLFFTCNGNSCQVDEEQSRKG

SEQ ID NO: 22713 - protein, 879 aa, Escherichia coli PCN033
MPEHSFLRLRGLSWWIALAISGSPFNALADDTIQFDGRFLDLKGNTKIDLGRFSQKGYVEPGKYNLRVHVNNQPLPDDYDIYWYATENDPNKSYACLSPELVAQFGLKEDIAKNLQWIRDGQCLNTALLAGTEISGDLGQSALLVSVPQAYLEYTDSEWDPPSRWDDGIPGLIADYSINAQTRHENGGDDTNDISGNGTVGVNVGPWRLRADWQSDYQHTRSNDDGDTDDSCTQKNWEWSRYYAWRALPSLKAKLSLGEDYLNSDIFDGFSYIGGSISTDDQMLPPNLRGYAPDISGVAHTTAKVTVTQMGRVIYETQVPAGPFRIQDIGDSVSGTLHVRIEEQNGQVQEYDVSTASMPFLTRPGQVRYKVTMGRPQNWDHQVAGSFFSGGEASWGIANGWSLYGGALADENYQSAALGLGRDLALLGALAFDVTHSRVQLDDNSVYGNKTLDGNSYRVSYAKDFDELNSRVTFAGYRFSEKNYMTMSEYLDANDDDRARTGNDKEMYTVTYNQNFTDARVSVYLNYSHHTYWDRQDQTNYNMMLSHYFNLGSLRNLSVSLTGYRYEYDKSADKGVYLSLSLPWGDNSTISYNGNYGSGADSNQVSLYHRIDDASHYTVSAGTSENHSSVDGYYSHDGTLAKVDLSANYHEGQYTSAGISLQGGATLTAHGGALHRTQNMGGTRLLIDADGVANVPVEGNGSAVYTNMFGKAVVADVNDYYRNQAYIDLNKLPENAEATKSVVQATLTEGAIGYRKFAVISGEKAMAVLRLQDGSHPPFGAEVKNDNQQQVGLVDDEGNVYLAGVKPGEHMTVSWEGESHCDISLPDPLPNDLFNGLLLPCQQKGGSSPVIPHDIQPVIQEQTQQVAPMEPPMSVSSNQ

SEQ ID NO: 22714 - protein, 432 aa, Escherichia coli PCN033; identical to SEQ ID NO: 5727

SEQ ID NO: 22715 - protein, 567 aa, Escherichia coli PCN033; identical to SEQ ID NO: 6075

SEQ ID NO: 22716 - protein, 285 aa, Escherichia coli PCN033
MKKYLALALIAPLLISCSTTKKGDTYNEAWVKDTNGFDILMGQFAHNIENIWGFKEVVIAGPKDYVKYTDQYQTRSHINFDDGTITIETIAGTEPAAHLRRAIIKTLLMGDDPSSVDLYSDVDDITISKEPFLYGQVVDNTGQPIRWEGRASNFADYLLKNRLKSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDIGTAYLAMLNNVYLGGI

SEQ ID NO: 22717 - protein, 420 aa, Escherichia coli PCN033
MRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPVLPAQNQALPPEVRAFLNAGRTR

SEQ ID NO: 22718 - protein, 689 aa, Escherichia coli PCN033
MIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITNGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTNAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 22719 - protein, 651 aa, Escherichia coli PCN033
MNNKNTFTGDKLSHAIKIALSGVVCSLLFVLPVHAVEFNVDMIDAEDRENIDISRFEKKGYIPPGRYLVRVQINKNMLPQTLILEWVKADNESGSLLCLTKENLTNFGLNTEFIESLQNIAGSECLDLSQRQELTTRLDKATMILSLSVPQAWLKYQATNWTPPEFWDAGIAGFILDYNVYASQYAPHHGDSTQNVSSYGTLGFNLGTWRLRSDYQYNQNFADGRSVNHDSEFARTYLFRPIPSLSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSDNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQ

SEQ ID NO: 22720 - protein, 246 aa, Escherichia coli PCN033; identical to SEQ ID NO: 22624

SEQ ID NO: 22721 - protein, 678 aa, Escherichia coli PCN033
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAAEIKLAQKDFAGAQNLLAKITPADLEQNQQARYWQVKIDASQGRPSIDLLRALIAQEPLLGAKEKQQNIDATWQALSSMTQEQANTLVINADENILQGWLDLQRIWFDNRNDPDMMKAGIADWQKRYPNNPGAKMLPTQLVNVKAFKPASTNKIALLLPLNGQAAVFGRTIQQGFEAAKNIGTQPVATQVAAAPAADVAEQPQPQTVDGVASPAQASVSDLTGEQPAAQPVPVNAPAATTAAVSAPANPSAELKIYDTSSQPLSQILNQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLTNHFSQMRQVQGFEINGNTGSLTANPDCVINRKLSWLQYQQGQVVPAS

SEQ ID NO: 22722 - protein, 386 aa, Escherichia coli PCN033
MVDDVPVAQVLQALAEQEKLNLVVSPDVSGTVSLHLTDVPWKQALQTVVKSAGLITRQEGNILSVHSVAWQNDNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADTQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 22723 - protein, 660 aa, Escherichia coli PCN033
MPRPQFTSLRLSLLALAVSATLPTFAFATETMTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 22724 - protein, 614 aa, Escherichia coli PCN033
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGEMIKSQLITSYSHSKDYNYDPHYGRYDSSATLDEMKQYTVQWANNVTVGHGNIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 22725 - protein, 446 aa, Escherichia coli PCN033; identical to SEQ ID NO: 7485

SEQ ID NO: 22726 - protein, 237 aa, Escherichia coli PCN033; identical to SEQ ID NO: 6384

SEQ ID NO: 22727 - protein, 478 aa, Escherichia coli PCN033
MTRIKINARRIFSLLIPFFFFTSVHAEQTAAPAKPVTVEAKNETFAPQHPDQYLSWKATSEQSERVDALTEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 22728 - protein, 368 aa, Escherichia coli PCN033
MNKTITALAIMMASFVANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVSKGDKTWLINGEAKPGLRTDAVFELDFTGNNLKWNKLAPVASPDGVAGGFAGMSNDSLIFAGGAGFKGSRENYQNGKNYAHEGLKKSYSADIHLWHNGKWDKSGELSRGRAYGVSLPWNNSLLIIGGETAGGKAVTDSVLISVKDNKVTVQN

SEQ ID NO: 22729 - protein, 241 aa, Escherichia coli PCN033; identical to SEQ ID NO: 6143

SEQ ID NO: 22730 - protein, 878 aa, Escherichia coli PCN033
MSYLNLRLYQRNTQCLHIRKHRLAGFFVRFFVACAFAAQAPLSSAELYFNPRFLADDPQAVADLSRFENGQELPPGTYRVDIYLNNGYMATRDVTFNTGDSEQGIVPCLTRAQLAGMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRSSTLYLSGSHQTYWGTNNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 22731 - protein, 234 aa, Escherichia coli PCN033
MKEAVSHIPVPRDGRDYDPDVLQKAVNDAVANIPQPADGKSLTPDDVRPMLEQMVKEAVSHIHVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTEDKPGEAHSSAWTLAAKRGRDAGGGK

SEQ ID NO: 22732 - protein, 725 aa, Escherichia coli PCN033; identical to SEQ ID NO: 6197

SEQ ID NO: 22733 - protein, 121 aa, Escherichia coli PCN033; identical to SEQ ID NO: 6175

SEQ ID NO: 22734 - protein, 208 aa, Escherichia coli PCN033; identical to SEQ ID NO: 5717

SEQ ID NO: 22735 - protein, 431 aa, Escherichia coli PCN033; identical to SEQ ID NO: 6791

SEQ ID NO: 22736 - protein, 233 aa, Escherichia coli PCN033
MKYKKLIILISLLFSNFSFSQSNGINLAATRVVFDSKEANASLKINNNSEEKTWLLRSWVSAYNNDEKVKNFIITPPLYRIDPTESFQLRINKINVHLPEDRESVFRINVLAIPSNYNNDTQEKRDSGLQFAINNRIKLIYRPHNLNVPKKVDDAYKALIFSKSENQVHVKNPTPYYITMNDVKINEKSITSIKDFMVSPFSTLIIPEKNAKTISYSTINDYGGKTPTQNIKL

SEQ ID NO: 22737 - protein, 351 aa, Escherichia coli PCN033
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 22738 - protein, 221 aa, Escherichia coli PCN033; identical to SEQ ID NO: 6115

SEQ ID NO: 22739 - protein, 871 aa, Escherichia coli PCN033
MHQVLLLPRFARLTIALGLATAVFPVDAEYYFNPRFLSNDLAESVDLSAFTKGREAPPGTYRVDIYLNDEFMTSRDITFIADDNNADLIPCLSTDLLVSLGIKKSALLDNKEHSAEKHVPDNSACTPLRDRLADASSEFNVGQQHLSLSVPQIYVGRMARGYVSPDLWEEGINAGLLNYSFNGNSINNRSNHNAGKSNYAYLNLQSGINIGSWRLRDNSTWSYNSGISNSSDSNKWQHINTSAERDIIPLRSRLTVGDSYTDGDIFDSVNFRGLKINSTEAMLPDSQHGFAPVIHGIARGTAQVSVKQNGYDVYQTTVPPGPFTINDINSAANGGDLQVTIKEADGSIQTLYVPYSSVPVLQRAGYTRYALAMGEYRSGNNLQSSPKFIQGSLMHGLEGNWTPYGGMQIAEDYQAFNLGIGKDLGLFGAFSFDITQANTTLADGTRHSGQSIKSVYSKSFYQTGTNIQVAGYRYSTQGFYNLSDSAYSRMSGYTVKPPTGDSNEQTQFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSVSNDLKGGMTNLSGVYGTLLPDNNLNYSVQVGNTHGGNTSSGTSGYSSLNYRGAYGNTNVGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGKDKNSNCIVEYKLPEVSPGTLLNQQTAICR

SEQ ID NO: 22740 - protein, 236 aa, Escherichia coli PCN033
MQTTRTPYSISFMATVLLLLLFACHSTVANAAVALGATRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGDVSVDIPHAATGDISFQTINDYGALTPRIKATMQ

SEQ ID NO: 22741 - protein, 714 aa, Escherichia coli PCN033
MAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAVFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 22742 - protein, 119 aa, Escherichia coli RN587/1; identical to SEQ ID NO: 5986

SEQ ID NO: 22743 - protein, 221 aa, Escherichia coli RN587/1; identical to SEQ ID NO: 8014

SEQ ID NO: 22744 - protein, 351 aa, Escherichia coli RN587/1
MKKSTLALVVMGIVASVSVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSTQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 22745 - protein, 746 aa, Escherichia coli RN587/1; identical to SEQ ID NO: 8287

SEQ ID NO: 22746 - protein, 193 aa, Escherichia coli RN587/1; identical to SEQ ID NO: 5868

SEQ ID NO: 22747 - protein, 430 aa, Escherichia coli RN587/1; identical to SEQ ID NO: 5758

SEQ ID NO: 22748 - protein, 331 aa, Escherichia coli RN587/1; identical to SEQ ID NO: 7536

SEQ ID NO: 22749 - protein, 760 aa, Escherichia coli RN587/1
MENNRNFPARQFHSLTFFAGLCIGITPVAQALAAEGQANADDTLVVEASTPSLYAPQKSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRNKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDVSTGVEFTRETQTNYGVNPVTLPAVNIYHPDSSIHPGGLTRNGANANGQTDTFAIYAFDTLQITRDFELNGGIRLDNYHTEYDSTTACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGFEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 22750 - protein, 191 aa, Escherichia coli RN587/1; identical to SEQ ID NO: 5748

SEQ ID NO: 22751 - protein, 232 aa, Escherichia coli RN587/1; identical to SEQ ID NO: 5747

SEQ ID NO: 22752 - protein, 729 aa, Escherichia coli RN587/1; identical to SEQ ID NO: 7833

SEQ ID NO: 22753 - protein, 213 aa, Escherichia coli RN587/1; identical to SEQ ID NO: 5744

SEQ ID NO: 22754 - protein, 161 aa, Escherichia coli RN587/1; identical to SEQ ID NO: 5769

SEQ ID NO: 22755 - protein, 266 aa, Escherichia coli RN587/1; identical to SEQ ID NO: 7806

SEQ ID NO: 22756 - protein, 731 aa, Escherichia coli RN587/1; identical to SEQ ID NO: 10965

SEQ ID NO: 22757 - protein, 221 aa, Escherichia coli RN587/1; identical to SEQ ID NO: 11133

SEQ ID NO: 22758 - protein, 200 aa, Escherichia coli RN587/1; identical to SEQ ID NO: 7803

SEQ ID NO: 22759 - protein, 658 aa, Escherichia coli RN587/1
MSQSIAFTVIEGKKNAQACITQKNLLQFHISSPDKNSGKAILLKRDDDLGDCLNLAEMISQSSIRYDVNDQRLDIDVPQAWIMKNYQNYVDPSLWENGINAAMLSYNLNGYHSESPGRTNDSIYAAFNGGINLGAWRLRASGNYNWMTNVHSDYDFQNRYLQRDLASLRSQLVIGESYTTGETFDSVSIRGIRLYSDSRMLPPVLASFAPIIHGVANTNAKVTVMQNGYKIYETTVPPGAFAIDDLSPSGYGSDLIVTIEEADGTKRTFSQPFSSVVQMLRPGVGRWDISAGQVLKDSIQDEPNLFQASYYYGLNNYLTGYTGIQLTDNNYTAGLLGLGMNTPVGAFSVDVTHSNVSIPDDKTYQGQSYRISWNKLFENTSTSLNIAAYRYSTQHYLGLNDALTLIDEVEHPEQDLEPKSMRNYSRMKNQVTVSINQPLKFEKKESPWGTLSGSASASSDNSRQFSLNTDGGFVLHSGGLTFSNDSFSDSDTLAVIQAPGAKGARINYGNSTVDRWSYGVTSALSPYHENRIALDINDLENDVELKSTSTVAIPRQGAVVFADFETVQGQSAIMNIVRSDGKNIPFAEDIYDEQNNIIGNVGQGGQAFVHGIEQEENIRITWIEEGKPVSCFAHYQQNTASEKIAQSIILNGLRCQIQ

SEQ ID NO: 22760 - protein, 170 aa, Escherichia coli RN587/1; identical to SEQ ID NO: 5855

SEQ ID NO: 22761 - protein, 784 aa, Escherichia coli RN587/1; identical to SEQ ID NO: 8272

SEQ ID NO: 22762 - protein, 237 aa, Escherichia coli RN587/1; identical to SEQ ID NO: 7546

SEQ ID NO: 22763 - protein, 446 aa, Escherichia coli RN587/1; identical to SEQ ID NO: 5873

SEQ ID NO: 22764 - protein, 614 aa, Escherichia coli RN587/1
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDHPGTEISAGWGSNSYQNYDVSTQQQLGDKTRVTLLGDYAHTHGYDVVAYGNTGTQAQPDNDGFLSKTLYGALEHNFTDVWSGFVRGYGYDNRTNYDAYYSPGLPLVDTRKLYSQSWDAGLRYNGELIKSQLITSYSHSKDYNYDPHYGRYDSSATLDEMKQYTVQWANNIIIGHGNIGAGVDWQKQSTAPGTAYVEDGYDQRNTGIYLTGLQQVGDFTFEGAGRSDDNSQFGRHGTWQTSAGWEFIEGYRFIASYGTSYKAPNLGQLYGSYGNPNLNPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGSRYDKDYSSYPYQTVKMGGVSLWDLAVAYPVTSHLTVRGKIANLFDKDYETVYGYQTAGREYTLSGSYTF

SEQ ID NO: 22765 - protein, 863 aa, Escherichia coli RN587/1
MHIRKHRLAGFFVRLFVACAFTAQAPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGSNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYHAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWMLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 22766 - protein, 241 aa, Escherichia coli RN587/1
MSNKNVNVRKSQEITFCLLAGILMFMAMMVAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPNQAAEKLRFRRSANSLTLINPTPYYLTVTELNAGTRVLENALVPPMGESAVKLPSDAGSNITYRTINDYGALTPKMTGVME

SEQ ID NO: 22767 - protein, 208 aa, Escherichia coli RN587/1; identical to SEQ ID NO: 5869

SEQ ID NO: 22768 - protein, 512 aa, Escherichia coli RN587/1
MKKISFFIFTALFCCSAQAAPSSLEKRLGKSEYFIITKSSPVRAILNDFAANYSIPVFISSSVNDDFSGEIKNEKPVKVLEKLSKLYHLTWYYDENILYIYKTNEISRSIITPTYLDIDSLLKYLSDTISVNKNSCNVRKITTFNSIEVRGVPECIKYITSLSESLDKEAQSKAKNKDVVKVFKLNYASATDITYKYRDQNVVVPGVVSILKTMASNGSLPSTGKGAVERSGNLFDNSVTISADPRLNAVVVKDREITMDIYQQLISELDIEQRQIEISVSIIDVDANDLQQLGVNWSGTLNAGQGTIAFNSSTAQANISSSVISNASNFMIRVNALQQNSKAKILSQPSIITLNNMQAILDKNVTFYTKVSGEKVASLESITSGTLLRVTPRILDDNSNSLTGKRRERVRLLLDIQDGNQSSNQSNAQDASSTLPEVQNSEMTTEATLSAGESLLLGGFIQDKESSSKDGIPLLSDIPVIGSLFSSTVKQKHSVVRLFLIKATPIKSASSE

SEQ ID NO: 22769 - protein, 229 aa, Escherichia coli RN587/1
MMKKKFIALTLWVLISQSALASGVGLSSTRVIYDGNKKEASLTVQNKNKSEEFLIQSWVDDATGSKKTPFIITPPLFKLEPGKNNILRIVNVNPSLPQDRESVYWVNVKAIPSQNEENEGKNVLQIAVRTRIKLFYRPAGLKGDIKSSPGELRFTRNGKQIKVDNPTVFNITFSDVFINGHEIEKSGMVPAKGALNINLPAGVNSASQIKYNTINDFGSSGEYLTREIN

SEQ ID NO: 22770 - protein, 856 aa, Escherichia coli RN587/1
MVVSRTYTSFFPFSLSVLALTVAGSFSATAGKFNPRFLEDTAGINQHVDLSMYETDHGAQLPGTYRVSLIVNEQKMETRTLEFKAATESQRKEMGEFLIPCLSRTQLADMGVRVDSFSALNLIPAEACVAFNEIIPQATSHFDFSEQKLVMSFPQAAMQQVARGTVPESRWDDGVPALLLDYSFSGSNSSHDTKSYNRYIDENGNHHQDKNETSQTNDSYYLSMRSGLNLGAWRLRNYSNWSYSNGEKQWDNIGTYVTRAIVPLKAQLTLGDTATPSDIFDSVQMRGALLASDEEMLPDSQRGFAPVVRGIAKSNAEVSIEQNGYVIYRAFVQPGAFEINDLYPTANSGDLTVIVKEADGSEQRFIQPFSSVAVFQREGHLKYSLSAGEYRAGNYDSANPRFGQFNAMYGLPFGMTTYGGALISKDYNAFALGLGKNFGSIGAISVDITQAKSTLNNNATDQGQSYRFLYSKSFASGTDFRLLGYKYSTSGFYTFQEATDVRSGADSDYGRYHKRSEIQGNLTQQLGTYGSVYFNMTQQDYWNDDGKRLSLATGYNGRIGRVNYSIAYSWNKSPEWDENDQLWSFNISIPFGRAWSNYRVTTDQDGRTIQQLGVNGTLLEDRNLSYNVQEGYSSNGVGNSGNASLAYQGGAGNISVGYSYGKDYQQTNYSLRGGIVAHSEGISLSQPLGETIAIVSAPGARGAKVLNNSGVSVDWQGNAVVPYLSIYRENDVSIRSETLNDSVDMNSAFQTIVPTRGAVVRAHFDTRVGYRVLMTLIRQNGVSVPFGATATLVSDTTEQISGIVGEDGQLYISGMPKTGNVKIVWGKDTSQQCVAKYELPVEEKNSGIISVTANCQ

SEQ ID NO: 22771 - protein, 678 aa, Escherichia coli RN587/1
MVPSTFSRLKAARCLPVVLAALIFAGCGTHTPDQSTAYMQGTAQADSAFYLQQMKQSSDDTRINWQLLAIRALVKEGKTGQAVELFNQLPQELNDSQRREKTLLAAEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILNQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRETTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 22772 - protein, 660 aa, Escherichia coli RN587/1; identical to SEQ ID NO: 6837

SEQ ID NO: 22773 - protein, 386 aa, Escherichia coli RN587/1; identical to SEQ ID NO: 8261

SEQ ID NO: 22774 - protein, 432 aa, Escherichia coli RN587/1; identical to SEQ ID NO: 5727

SEQ ID NO: 22775 - protein, 505 aa, Escherichia coli RN587/1
MYKKTTLAVLIALLTGATTVHAQTDISSIESRLAALEQRLKNAESRAQAAEARAKTAELQVQKLAETQQQNQLTTQEVAQRTVQLEQKSAENSGFEFHGYARSGLLMNDAASSSKSGPYLTPAGETGGAVGRLGNEADTYVELNVEHKQTLDNGATTRFKAMLADGQRDYNDWTGGSSNLNIRQAFAELGALPSFTGAFQDSTVWAGKRFDRDNFDIHWLDSDVVFLAGTGGGIYDVKWNDTFRSNFSLYGRNFGDLDDIDNNVQNYILTMNHYAGPFQLMVSGLRAKDNDDRKDANGDLIQTDAANTGVHALVGLHNDSFYGLREGTAKTALLYGHGLGAEVKGIGSDGALLSEANTWRFASYGTTPLGSGWYVAPAILAQSSKDRYVKGDSYEWVTFNTRLIKEVTQNFALAFEGSYQYMDLKPKGYQNHNAVNGSFYKLTFAPTLKANDINNFFSRPELRLFATWMDWSSKLDDFASNDAFGSSGFNTGGEWNFGVQMETWF

SEQ ID NO: 22776 - protein, 249 aa, Escherichia coli RN587/1
MNIMKSPLITTGMIYLLGICNFAQATVSPDRTRIIFNASNKSATVRLTNQSKIDPYLAQSWIEDASGKKTRDYISTLPPMERIEPDEQVQIRLMALASLNNLPQDRETLFYYNVREIPPRAKEQNVMQIAMQSRLKLFWRPKAIELKEGEMIPLQKVTITRTAAGLTLNNPTPYHITVGYIGTNGKTLMPGADSIMVAPFTSATQHLSSLPSTFQLGFVADYGGLEMFKVECNSIQSLCQSSPAKKGKI

SEQ ID NO: 22777 - protein, 799 aa, Escherichia coli RN587/1
MIDAEDRENIDISRFEKKGYIPPGRYLVRVQINKNMLPQTLILEWVKADNESGSLLCLTKENLTNFGLNTEFIELLQNIAGSECLDLSQRQELTTRLDKATMILSLSVPQAWLKYQATNWTPPEFWDTGIAGFILDYNVYASQYAPHHGDSTQNVSSYGTLGFNLGAWRLRSDYQYNQNFADGRPVNRDSEFARTYLFRTIPSWSSKFTMGQYDLSSNLYDTFHFTGASLESDESMLPPDLQGYAPQITGIAQTNAKVTVAQNGRVLYQTTVAPGPFTISDLGQSFQGQLDVTVEEEDGRTSTFQVGSASIPYLTRKGQVRYKTSLGKPTSVGHNDINNPFFWTAEASWGWLNNVSLYGGGMFTADDYQAITTGIGFNLNQFGSLSFDVTGADASLQQQNSGNLRGYSYRFNYAKHFESTGSQITFAGYRFSDKDYVSMSEYLSSRNGDESIDNEKESYVISLNQYFETLELNSYLNVTRNTYWDSASNTNYSVSVSKNFDIGDFKGISASLAVSRIRWDDDEENQYYFSFSLPLQQNRNISYSMQRTGSSNTSQMISWYDSSDRNNIWNISASATDDNIRDGEPTLRGSYQHYSPWGRLNINGSVQPNQYNSVTAGWYGSLTATRHGVALHDYSYGDNARMMVDTDGISGIEINSNRTVTNGLGIAVMPSLSNYTTSMLRVNNNDLPEGVDVENSVIRTTLTQGAIGYAKLNATTGYQIVGVIRQENGRFPPLGVNVTDKATGKDVGLVAEDGFVYLSGIQENSTLHLTCGDNTCEVTPPNQSNISESAIILPCKTVK

SEQ ID NO: 22778 - protein, 711 aa, Escherichia coli RN587/1
MFTPSFSGLKGRALFSLLFAAPMIHATDSVTTKDSETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSNLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 22779 - protein, 686 aa, Escherichia coli RN587/1
MFWRDITLSVWRKKTTGLKTKKRLLPLVLAAVLCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWGSKDAGLMQFANGTQIPIGTLGAAISAAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPHTAQPILPAQNQALPPEVRAFLNAGRTR

SEQ ID NO: 22780 - protein, 360 aa, Escherichia coli RN587/1; identical to SEQ ID NO: 6702

SEQ ID NO: 22781 - protein, 518 aa, Escherichia coli RN587/1
MKKLKINYLFIGILALLLAVALWPSIPWFGKADNRIAAIQARGELRVSTIHTPLTYNEINGKPFGLDYELAKQFADYLGVKLKVTVRQNISQLFDDLDNGNADLLAAGLVYNSERVKNYQPGPTYYSVSQQLVYKVGQYRPRTLGNLTAEQLTVAPGHVVVNDLQTLKDTKFPELSWKVDDKKGSAELMEDVIEGKLDYTIADSVAISLFQRVHPELAVALDITDEQPVTWFSPLDGDNTLSAALLDFFNEMNEDGTLARIEEKYLGHGDDFDYVDTRTFLRAVDAVLPQLKPLFEKYAKEIDWRLLAAIAYQESHWDAQATSPTGVRGMMMLTKNTAQSLGITDRTDAEQSISGGVRYLQDMMSKVPESVPENERIWFALAAYNMGYAHMLDARALTAKTKGNPDSWADVKQRLPLLSQKPYYSKLTYGYARGHEAYAYVENIRKYQISLVGYLQEKEKQATEAAMQLAQDYPAVSPTELGKEKFPFLSFLSQSSSNYLTHSPSLLFSRKGSEEKQN

SEQ ID NO: 22782 - protein, 882 aa, Escherichia coli RN587/1
MPNHSNFRLRGIACYIALAISGGSVNAWADDSIQFDPRFLELKGDTKIDLGKFSKKGYVDAGKYNLRVFINKQPLSDEYDINWYVSENDPTKNYACLTPELVAALGLKEGIAKSLQWTHNDECLKPGQLDGMEVENDLSQSALLLTVPQAYLEYTSSDWDPPSRWDDGIPGLIADYSLNAQTRHQEQGGEDSHDISGNGTVGANLGAWRFRADWQSDYQHTRSNDDDDDSSNSTTSKHWDWSRYYAWRALPSLKAKLSLGEDYLNSDIFDGFNYIGSSVSTDDQMLPPNLRGYAPDVSGVAHSSAKVTISQMGRVLYETQVPAGPFRIQDIGDSVSGTLHVRVEEQNGQVQEYDVTTASMPFLTRQGQVRYKVMMGRPEDWNHKTEGGFFSGGEASWGVADGWSLYGGALADKHYQSAAMGVGRDLAQFGALAFDVTHSHVNLDHDSAYGKGKLDGNSFRVSYAKDFDELNSRVTFAGYRFSEKNFMTMSEYLDANQSDMARTGNDKEMYTITYNQNFAAAGVSIYLNYSHRTYWDRPEQTNYNLMFSHYFNMGSIRNMSISVTGYRYEYDDNADKGMYLSMSIPWSDSSTVTYNGSYGSGSDSSQVGYFKRVDDATHYQVNVGTSEQHGSVDGYLSHDGSLAKVDLSANYHEGEYRSAGIALQGGATLTAHGGALHRTQNMGGTRLLIDADGIANVPVESNGAPVYTNMFGKAVVADINNYYRNQAYIDLNNLPEDAEATQSVVQATLTEGAIGYRKFKVISGQKAMAVLRLRDGSYPPFGAEVKNDEQQQVGIVDDEGNVYLAGVNADEHMMVFWEGSAQCEIVLPKPLPADLFSGLLLPCEQKGTAAPDSSAPEIKPVIQDQKRQVTPTEAPTSISATQ

SEQ ID NO: 22783 - protein, 242 aa, Escherichia coli RN587/1
MLVSTALMAMLTTASLTAHASVTPDRTRLVFNESDKSISVTLRNNNEKLPYLAQSWLEDEKGNKITSPLAVLPPVQRIDAMMNGQVKIQALPDIHTLPSDRESLFYYNVREIPPKSGKANTLQIALQTRIKLFWRPKALEKIDMRKPWQFKVTLTRSGQDYTVNNPTPYHVIISDASTQKKGLTAAGFKPLVMPPKTSQPLKAKLASAPVLTYINDYGARMPLIFRCEGNTCKVDEDQSSKG

SEQ ID NO: 22784 - protein, 274 aa, Escherichia coli RN587/1; identical to SEQ ID NO: 5899

SEQ ID NO: 22785 - protein, 192 aa, Escherichia coli RN587/1; identical to SEQ ID NO: 7823

SEQ ID NO: 22786 - protein, 371 aa, Escherichia coli RN587/1
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYSSDNFMQQRGNGFATYRNTDFFGLVDGLNFAVQYQGKNGSPSGEGMTGVTNNGRDVLEQNGDGVGGSITYDIGEGFSFGGAISSSKRTAEQNNYGIGNGDRAETYTGGLKYDANNVYLAAQYTQTYNATLAGDLGWANKAQNFEVVAQYQFDFGLRPSVAYLQSKGKNLNANIAGRTYDDEDLLKYVDVGATYYFNKNMSTYVDYKINLLDDNQFTRAAGINTDNIVALGLVYQF

SEQ ID NO: 22787 - protein, 162 aa, Escherichia coli RN587/1; identical to SEQ ID NO: 5896

SEQ ID NO: 22788 - protein, 828 aa, Escherichia coli RN587/1; identical to SEQ ID NO: 17746

SEQ ID NO: 22789 - protein, 641 aa, Escherichia coli RN587/1; identical to SEQ ID NO: 7819

SEQ ID NO: 22790 - protein, 224 aa, Escherichia coli RN587/1
MKGLLALLISSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFCLNVLDIPPNSPEQEGKNALKFAMQNRIKLFYRPAGIAPVNKETFKKLLVNRSGNGLVIKNDSANWVTISDVKANNVKVNYETIMIAPLESQSVNVKSNNANNWHLTIIDDHGNYISDKI

SEQ ID NO: 22791 - protein, 656 aa, Escherichia coli RN587/1; identical to SEQ ID NO: 7810

SEQ ID NO: 22792 - protein, 565 aa, Escherichia coli RN587/1
MKSPAPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPKPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILSRASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPLSESTTQPVKQKEAEPTP

SEQ ID NO: 22793 - protein, 207 aa, Escherichia coli RN587/1; identical to SEQ ID NO: 7443

SEQ ID NO: 22794 - protein, 551 aa, Escherichia coli RN587/1; identical to SEQ ID NO: 5742

SEQ ID NO: 22795 - protein, 700 aa, Escherichia coli RN587/1
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNRGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYIPEDGWYAGTEARYMGDIMADDENTAKAPSYTLVGLFTGYKYNYHNFTVDLFGRVDNLFDKEYVGSVIVNESNGRYYEPAPGRNYGVGINIAWRFE

SEQ ID NO: 22796 - protein, 883 aa, Escherichia coli RN587/1
MTAFRAAFKAYRMHQVLLLPRFARLTIALGLATAVFPVDAEYYFNPRFLSNDLAESVDLSAFTKGHEAPPGTYRVDIYLNDEFMTSRDITFIADDNNADLIPCLSTDLLVSLGIKKSALLDNKEHLAEKHVSDNSACTPLRDRLADASSEFNVGQQHLSLSVPQIYVGRMARGYVSPDLWEEGINAGLLNYSFNGNSINNRSNHNAGKSNYAYLNLQSGINIGSWRLRDNSTWSYNSGSSNSSDSNKWQHINTSAERDIIPLRSRLTVGDSYTDGDIFDSVNFRGLKINSTEAMLPDSQHGFAPVIHGITRGTAQVSVKQNGYDVYQTTVPPGPFTIDDINSAANGGDLQVTIKEADGSIQTLYVPYSSVPVLQRAGYTCYALAMGEYRSGNNLQSSPKFIQGSLMHGLEGNWTPYGGMQIAENYQAFNLGIGKDLGLFGAFSFDITQANTTLADDTRHSGQSLKSVYSKSFYQTGTNIQVAGYRYSTQGFYNLSDSAYSRMSGYTVKPPTGDTSEQTLFIDYFNLFYSKRGQEQISISQQLGNYGTTFFSASRQSYWNTSRSDQQISFGLNVPFGDITTSLNYSYSNNIWQNDRDHLLAFTLNVPFSHWMRTDSQSAFRNSNASYSMSNDLKGGMTNLSGVYGTLLPDNNLNYSVQVGNTHGGNTSSGTSGYSSLNYRGAYGNTNIGYSRSGDSSQIYYGMSGGIIAHADGITFGQPLGDTMVLVKAPGADNVKIENQTGIHTDWRGYAILPFATEYRENRVALNANSLADNVELDETVVTVIPTHGAIARATFNAQIGGKVLMTLKYGNKSVPFGAIVTHGENKNGSIVAENGQVYLTGLPQSGKLQVSWGNDKNSNCIVDYKLPAVSPGTLLNQQTAICR

SEQ ID NO: 22797 - protein, 236 aa, Escherichia coli RN587/1
MQTTRTPYSISFMATVLLLLLFACHSTVANAAVALGVTRVIYPANQKQVLLPVTNNDPASVYLIQSWIENAGDQKDTQFVITPPLFSMQGKKENTLRIINATNHQLPGDRESLFWVNVKAIPAMEKDQKNENTLQLAIISRIKMFYRPTNLAMAPEEAPAMLRFRRSGSKLTLINPTPYFITVTNMKAGNSNLPNTMVPPKGEVSVDIPHAATGDISFQTINDYGALTPRIKATMQ

SEQ ID NO: 22798 - protein, 102 aa, Escherichia coli RN587/1; identical to SEQ ID NO: 8440

SEQ ID NO: 22799 - protein, 118 aa, Escherichia coli RN587/1 [sequence omitted]

SEQ ID NO: 22800 - protein, 203 aa, Escherichia coli RN587/1; identical to SEQ ID NO: 6414

SEQ ID NO: 22801 - protein, 355 aa, Escherichia coli RN587/1; identical to SEQ ID NO: 7838

SEQ ID NO: 22802 - protein, 268 aa, Escherichia coli STEC_7v
MLPDSMQSFTPLVQGIAQSNALITVSQNGYIIYQKEVPPGPFTIADLQLSGSGSDLDVSIKEADGSVRSFLVPYSSVPNMLQPGVSNFDFIAGRSKIYGVKNQEDFLEANYIYGLNNLLTLYGGTILSDNYNAITLGNGWNTPLGAISFDATRSSSKLNNDITHEGTSYQVAYNKYLVQTATRFSVAAWRYASQDYRTFSDHLYENDKHNHHSEYDDFYDIGRKNSLSANIMQPLSTGIKIALNDEQNLFCTITFKNVIDENKTYICQ

SEQ ID NO: 22803 - protein, 784 aa, Escherichia coli STEC_7v; identical to SEQ ID NO: 14072

SEQ ID NO: 22804 - protein, 170 aa, Escherichia coli STEC_7v; identical to SEQ ID NO: 5855

SEQ ID NO: 22805 - protein, 868 aa, Escherichia coli STEC_7v; identical to SEQ ID NO: 15819

SEQ ID NO: 22806 - protein, 244 aa, Escherichia coli STEC_7v; identical to SEQ ID NO: 15818

SEQ ID NO: 22807 - protein, 721 aa, Escherichia coli STEC_7v
MSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEIQFKAGTDSLFQTGFDFSDALDDDGVYSYRLTGIARSANAQQKGAEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPANSGPYRILNKQKQTGVYVQDQAQWDKVLVTLGGRYDWADQESHNRVEGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFEGPLSGLTLGTGGRFTGSSYGDPANSFKVGSYTVVDALVRYDLARVGMAGSNVALHVNNLFDREYVASCFNTYGCFWGAERQVVATATFRF

SEQ ID NO: 22808 - protein, 266 aa, Escherichia coli STEC_7v; identical to SEQ ID NO: 8089

SEQ ID NO: 22809 - protein, 161 aa, Escherichia coli STEC_7v; identical to SEQ ID NO: 5769

SEQ ID NO: 22810 - protein, 221 aa, Escherichia coli STEC_7v
MKNYLWLVALLPLLSGCESQAILVKKDDAYFAPPKTEAPPPADGRAGGLFETGYNWSLTADRRAYRVGDILTVILEESTQSSKQAKTNFGKSNSVDITAPTVFGHTKNNLSGSIDANRDFDGSATSQQQNSLRGEITVSVHAVQPNGILEIRGEKWLTLNQGDEYIRLSGLVRADDIQNDNSVSSQRIADARISYAGRGALSDANAAGWLTRLFNHPLFPI

SEQ ID NO: 22811 - protein, 351 aa, Escherichia coli STEC_7v; identical to SEQ ID NO: 15811

SEQ ID NO: 22812 - protein, 230 aa, Escherichia coli STEC_7v; identical to SEQ ID NO: 15812

SEQ ID NO: 22813 - protein, 869 aa, Escherichia coli STEC_7v; identical to SEQ ID NO: 8606

SEQ ID NO: 22814 - protein, 365 aa, Escherichia coli STEC_7v; identical to SEQ ID NO: 7354

SEQ ID NO: 22815 - protein, 746 aa, Escherichia coli STEC_7v; identical to SEQ ID NO: 15779

SEQ ID NO: 22816 - protein, 193 aa, Escherichia coli STEC_7v; identical to SEQ ID NO: 6300

SEQ ID NO: 22817 - protein, 243 aa, Escherichia coli STEC_7v; identical to SEQ ID NO: 15781

SEQ ID NO: 22818 - protein, 618 aa, Escherichia coli STEC_7v; identical to SEQ ID NO: 15782

SEQ ID NO: 22819 - protein, 430 aa, Escherichia coli STEC_7v; identical to SEQ ID NO: 5758

SEQ ID NO: 22820 - protein, 191 aa, Escherichia coli STEC_7v; identical to SEQ ID NO: 5748

SEQ ID NO: 22821 - protein, 232 aa, Escherichia coli STEC_7v; identical to SEQ ID NO: 5747

SEQ ID NO: 22822 - protein, 729 aa, Escherichia coli STEC_7v; identical to SEQ ID NO: 15794

SEQ ID NO: 22823 - protein, 213 aa, Escherichia coli STEC_7v; identical to SEQ ID NO: 5744

SEQ ID NO: 22824 - protein, 89 aa, Escherichia coli STEC_7v; identical to SEQ ID NO: 6214

SEQ ID NO: 22825 - protein, 111 aa, Escherichia coli STEC_7v; identical to SEQ ID NO: 5889

SEQ ID NO: 22826 - protein, 118 aa, Escherichia coli STEC_7v [sequence omitted]

SEQ ID NO: 22827 - protein, 397 aa, Escherichia coli STEC_7v
MKRKVLAMLVPALLVAGAANAAEVYNKDGNKLDFYGKVAGLHYFSDNSGADGDMSYARIGFKGETQIADQFTGYGQWEYNLQANGTEGDGDNSATRLAFAGLGFGQNGTFDYGRNYGVVYDIEAWTDMLPEFGGDTYAGADNFMNGRTNGVATYRNNGFFGQVDGLNFALQYQDNNESGGPFGQEGSGSGDGRSLSKENGDGFGMSTSYDFDFGLSLGAAYSNSDRSDRQVGVGLNDRNHSNRNAGGETAEAWTVGAKYDANNVYLAAMYAETRNMTPYGGGEFDNGESRSAIANKTQNFEVVAQYQFDFGLRPSIAYLQSKGKDLGGWAHDGNGDPRYTNKDLVKYVEVGATYYFNKNMSTYVDYKINLLDNDDDFYEANGIATDDIVAVGLVYQF

SEQ ID NO: 22828 - protein, 826 aa, Escherichia coli STEC_7v; identical to SEQ ID NO: 15768

SEQ ID NO: 22829 - protein, 224 aa, Escherichia coli STEC_7v; identical to SEQ ID NO: 15769

SEQ ID NO: 22830 - protein, 637 aa, Escherichia coli STEC_7v
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFVTVGGEWRHDKLSDAVNLTGGTSSKTSASQYALFVEDEWRIFEPLALTTGVRMDDHETYGEHWSPRAYLVYNATDTVTVKGGWVTAFKAPSLLQLSPDWTSNSCRGACKIVGSSDLKPETSESWELGLYYMGEEGWLEGVESSVTVFRNDVKDRISISRTSDVNAAPGYQNFVGFTADGVPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 22831 - protein, 828 aa, Escherichia coli STEC_7v; identical to SEQ ID NO: 6558

SEQ ID NO: 22832 - protein, 162 aa, Escherichia coli STEC_7v; identical to SEQ ID NO: 8101

SEQ ID NO: 22833 - protein, 367 aa, Escherichia coli STEC_7v; identical to SEQ ID NO: 15773

SEQ ID NO: 22834 - protein, 200 aa, Escherichia coli STEC_7v
MLAFCRSSLKSKKYFIILLVLAAIAGLGTHAAWSSNGLPRIDNKTLARLAQQHTVVVLFRHAERCDRSTNQCLSDKTGITVKGTQDARELGNAFSADIPDFDLYSSNTVRTIQSATWFSAGKKLTVDKRLLQCGNEIYSAIKDLQSKAPDKNIVIFTHNHCLTYIAKDKRDATFKPDYLDGLVMHVEKGKVYLDGEFVNH

SEQ ID NO: 22835 - protein, 274 aa, Escherichia coli STEC_7v; identical to SEQ ID NO: 15775

SEQ ID NO: 22836 - protein, 249 aa, Escherichia coli STEC_7v; identical to SEQ ID NO: 15776

SEQ ID NO: 22837 - protein, 878 aa, Escherichia coli STEC_7v; identical to SEQ ID NO: 15777

SEQ ID NO: 22838 - protein, 518 aa, Escherichia coli STEC_7v; identical to SEQ ID NO: 15778

SEQ ID NO: 22839 - protein, 432 aa, Escherichia coli STEC_7v; identical to SEQ ID NO: 5727

SEQ ID NO: 22840 - protein, 505 aa, Escherichia coli STEC_7v
MKKQISGNFDLTEPYALIERLSAQMGLIWYDDGKAIYIYDSSEMRNALINLRKVSTNEFNNFLKKSGLYNSRYEIKGGGNGTFYVSGPPVYVDLVVNAAKLMEQNSDGIEIGRNKVGIIHLVNTFVNDRTYELRGEKIVIPGMAKVLSTLLNNNIKQSTGVNVLSEISSRQQLKNVSRMPPFPGAEEDDDLQVEKIISTAGAPETDDIQIIAYPDTNSLLVKGTVSQVDFIEKLVATLDIPKRHIELSLWIIDIDKTDLEQLGADWSGTIKIGSSLSASFNNSGSISTLDGTQFIATIQALAQKRRAAVVARPVVLTQENIPAIFDNNRTFYTKLVGERTAELDEVTYGTMISVLPRFASRNQIELLLNIEDGNEINSDKTNVDDLPQVGRTLISTIARVPQGKSLLIGGYTRDTNTYESRKIPILGSIPFIGKLFGYEGTNANNIVRVFLIEPREIDERMMNNANEAAVDARAITQQMAKNKEINDELLQKWIKTYLNREVVGG

SEQ ID NO: 22841 - protein, 360 aa, Escherichia coli STEC_7v; identical to SEQ ID NO: 6702

SEQ ID NO: 22842 - protein, 686 aa, Escherichia coli STEC_7v; identical to SEQ ID NO: 15799

SEQ ID NO: 22843 - protein, 840 aa, Escherichia coli STEC_7v; identical to SEQ ID NO: 15800

SEQ ID NO: 22844 - protein, 246 aa, Escherichia coli STEC_7v
MKSLLTVTGMICLLGFCNFAQATVSPDRTRIIFNASNKSATVRLTNQSKIDPYLAQSWIEDASGKKTRDYISTLPPMERIEANEQVQIRLMALSALNNLPQDRETLFYYNVREIPPRAKEQNVMQIAMQSRLKLFWRPKSIELKEGEMVPLQKLTITHSAAGLTLNNPTPYHITVGYIGTNGKTLMPGTDSIMVTPFGTATQQIKNLPTTFLLGFVGDYGGLEMFKIDCNSVQSLCQATPAKKGKL

SEQ ID NO: 22845 - protein, 678 aa, Escherichia coli STEC_7v; identical to SEQ ID NO: 15802

SEQ ID NO: 22846 - protein, 386 aa, Escherichia coli STEC_7v
MVDDVPVAQVLQALAEQEKLNLVVSPDVSGTVSLHLTDVPWKQALQTVVKSAGLITRQEGNILSVHSVAWQNDNIARQEAEQARAQANLPLENRSITLQYADAGELAKAGEKLLSAKGSMTVDKRTNRLLLRDNKAALSALEQWVAQMDLPVGQVELSAHIVTINEKSLRELGVKWTLADAQQAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 22847 - protein, 210 aa, Escherichia coli STEC_7v; identical to SEQ ID NO: 15804

SEQ ID NO: 22848 - protein, 614 aa, Escherichia coli STEC_7v; identical to SEQ ID NO: 15831

SEQ ID NO: 22849 - protein, 208 aa, Escherichia coli STEC_7v; identical to SEQ ID NO: 5717

SEQ ID NO: 22850 - protein, 446 aa, Escherichia coli STEC_7v; identical to SEQ ID NO: 15805

SEQ ID NO: 22851 - protein, 368 aa, Escherichia coli STEC_7v; identical to SEQ ID NO: 15808

SEQ ID NO: 22852 - protein, 224 aa, Escherichia coli STEC_7v
MLAGILMIMAMMAAGRAEAGVALGATRVIYPAGQKQVQLAVTNNDENSTYLIQSWVENADGVKDGRFIVTPPLFAMKGKKENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKLPSDAGSNITYRTINDYGALTPKMTGVMV

SEQ ID NO: 22853 - protein, 878 aa, Escherichia coli STEC_7v; identical to SEQ ID NO: 15810

SEQ ID NO: 22854 - protein, 207 aa, Escherichia coli STEC_7v; identical to SEQ ID NO: 15825

SEQ ID NO: 22855 - protein, 331 aa, Escherichia coli STEC_7v; identical to SEQ ID NO: 6456

SEQ ID NO: 22856 - protein, 760 aa, Escherichia coli STEC_7v; identical to SEQ ID NO: 15785

SEQ ID NO: 22857 - protein, 203 aa, Escherichia coli STEC_7v; identical to SEQ ID NO: 6414

SEQ ID NO: 22858 - protein, 361 aa, Escherichia coli STEC_7v
MKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNISGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 22859 - protein, 224 aa, Escherichia coli STEC_7v; identical to SEQ ID NO: 15788

SEQ ID NO: 22860 - protein, 851 aa, Escherichia coli STEC_7v
MPSFIGGLVVFVSAVFTAQAEIWFDPAFFKDDPSMVADLSRFEKGQKITPGVYRVDIVLNQTIVDTRNVNFVEITPEKGIAACLTTENLDAMGMNTDAFPAFKQLDKQACAPLAEIIPDASVTFNVNKLRLEISVPQIAIKSNARGYVPPERWDEGINALLLGYSFSGANSIHSSTDSDSTDSYFLNLNSGVNLGPWRLRNYSTWSRSSGQTAEWKNLSSYLQRAVIPLKGELTVGDDYTAGDFFDSVSFRGVQLASDDNMLPDSLKGFAPLVRGIAKSNAQITIKQNGYTIYQTYVSPGAFEISDLYSTSSSGDLLVEIKESDGSVNSYSVPFSSVPLLQRQGRIKYAVTLAKYRTNSNDQQESKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDMPLWSRYYNLFYTKRGKLQVNISQQLGEYGSFYLSGSQQTYWHTDQQDRLLQFGFNTQIKDLSLGVSWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIVLDAASLKRNVDLENAVVNVVPTKGALVLAEFNAHAGARVLMKTLKQGIPLPFGAIATLDGIQTNSGIIDDDGSLYMSGLPAQGAITVRWGEAPDQICHISYELTEQQINAAITRMNAICR

SEQ ID NO: 22861 - protein, 245 aa, Escherichia coli STEC_7v
MPARHLYFIMTNPWNRLTLSIFAVLSLLVAGELQAGVVVGGTRFIFPAHRESISISLTNTSQESWLINSKINRSTRWAGGEASTVPVPLLAAPPLVFLKPSTTGTLRLLRTESDMLPVDRETLFELNIASVPSGKVENQNVKVAMRSVFKLFWRPEGLPGDPLEAYQQLRWSRNSQGLQLTNPTPYYINLIQVSVNGKALSNAGVVPPKSQRQTSWCQAIAPCHVAWRAINDYGGLSAKKEQDLP

SEQ ID NO: 22862 - protein, 539 aa, Escherichia coli STEC_7v; identical to SEQ ID NO: 6525

SEQ ID NO: 22863 - protein, 700 aa, Escherichia coli STEC_7v; identical to SEQ ID NO: 15836

SEQ ID NO: 22864 - protein, 366 aa, Escherichia coli STEC_7v; identical to SEQ ID NO: 15832

SEQ ID NO: 22865 - protein, 236 aa, Escherichia coli STEC_7v; identical to SEQ ID NO: 15834

SEQ ID NO: 22866 - protein, 203 aa, Escherichia coli STEC_7v; identical to SEQ ID NO: 6347

SEQ ID NO: 22867 - protein, 656 aa, Escherichia coli STEC_7v; identical to SEQ ID NO: 15823

SEQ ID NO: 22868 - protein, 565 aa, Escherichia coli STEC_7v; identical to SEQ ID NO: 15824

SEQ ID NO: 22869 - protein, 170 aa, Escherichia coli STEC_94C [sequence omitted]

SEQ ID NO: 22870 - protein, 765 aa, Escherichia coli STEC_94C; identical to SEQ ID NO: 9418

SEQ ID NO: 22871 - protein, 246 aa, Escherichia coli STEC_94C; identical to SEQ ID NO: 6342

SEQ ID NO: 22872 - protein, 747 aa, Escherichia coli STEC_94C; identical to SEQ ID NO: 6343

SEQ ID NO: 22873 - protein, 266 aa, Escherichia coli STEC_94C; identical to SEQ ID NO: 5772

SEQ ID NO: 22874 - protein, 161 aa, Escherichia coli STEC_94C; identical to SEQ ID NO: 5769

SEQ ID NO: 22875 - protein, 351 aa, Escherichia coli STEC_94C; identical to SEQ ID NO: 19439

SEQ ID NO: 22876 - protein, 230 aa, Escherichia coli STEC_94C; identical to SEQ ID NO: 6294

SEQ ID NO: 22877 - protein, 820 aa, Escherichia coli STEC_94C; identical to SEQ ID NO: 7925

SEQ ID NO: 22878 - protein, 365 aa, Escherichia coli STEC_94C; identical to SEQ ID NO: 7354

SEQ ID NO: 22879 - protein, 746 aa, Escherichia coli STEC_94C; identical to SEQ ID NO: 6296

SEQ ID NO: 22880 - protein, 193 aa, Escherichia coli STEC_94C; identical to SEQ ID NO: 6300

SEQ ID NO: 22881 - protein, 243 aa, Escherichia coli STEC_94C; identical to SEQ ID NO: 6463

SEQ ID NO: 22882 - protein, 816 aa, Escherichia coli STEC_94C; identical to SEQ ID NO: 6462

SEQ ID NO: 22883 - protein, 430 aa, Escherichia coli STEC_94C; identical to SEQ ID NO: 5758

SEQ ID NO: 22884 - protein, 331 aa, Escherichia coli STEC_94C; identical to SEQ ID NO: 6551

SEQ ID NO: 22885 - protein, 760 aa, Escherichia coli STEC_94C; identical to SEQ ID NO: 16205

SEQ ID NO: 22886 - protein, 203 aa, Escherichia coli STEC_94C; identical to SEQ ID NO: 6414

SEQ ID NO: 22887 - protein, 807 aa, Escherichia coli STEC_94C
MWNLLRRTRKNQKSGRDVREAGWTSLFQAVAEPFSGAWQQGVKADPEAVLSFHAVFACISLISQDIAKMRLRLMQTDAHGIRRETRRGDIARLCRRPNAQQNRIQFFELWLNAKLRHGNTVVLKIRNARGQIKELRILDWNRVEPLVADDGEVFYRITPDRNCGITEAVTVPAREVIHDRFNCFFHPLIGLPPVYAAGLAATQGHHIQENSTSFFRNGGRPSGVIEIPGSITEENAKKLKSNWDSGYTGENAGKTAILSNGAKYNPTTFSPVDAQTVEQLKMTAEIVCSVFRVPAYKIGVGQPPSSDNVEALEQQYYSQCLQTLIESIELLLDEALETGENESTEFDVTTLLRMDSERRMKTLGDAVKNTLLTPNEARKRENLPPLAGGDALYLQQQNYSLEALSRRDAREDPFALTGKTALAQPPDGASDGNKAISETEHDAVKAMFRGDTAKMTERELSIIRALGEEFSAVLADLQRTFEGKIAAQAQTFEEKLASLSVVLQKCVTGDDVRPMLEQMVKEAVSHIPVPRDGRDYDPEVLQKAVNDAVANIPQPADGKSLTPDDVRPMLEQMVKEAVSHIPVPRDGRDYDPEVLQKAVNDAVANIPQPADGKSITPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTGDKPGEAHSSAWTLAAKRGRDAGGGK

SEQ ID NO: 22888 - protein, 203 aa, Escherichia coli STEC_94C; identical to SEQ ID NO: 6347

SEQ ID NO: 22889 - protein, 207 aa, Escherichia coli STEC_94C; identical to SEQ ID NO: 5743

SEQ ID NO: 22890 - protein, 361 aa, Escherichia coli STEC_94C; identical to SEQ ID NO: 7868

SEQ ID NO: 22891 - protein, 224 aa, Escherichia coli STEC_94C; identical to SEQ ID NO: 7869

SEQ ID NO: 22892 - protein, 591 aa, Escherichia coli STEC_94C
MPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKITHG

SEQ ID NO: 22893 - protein, 130 aa, Escherichia coli STEC_94C
MPVDRETLFELSIASVPSGKVENQSVKVAMRSVFKLFWRPEGLPGDPLEAYQQLRWTRNSQGVQLTNPTPYYINLIQVSVNGKALSNAGVVPPKSQRQTSWCQAIAPCHVAWRAINDYGGLSAKKEQNLP

SEQ ID NO: 22894 - protein, 517 aa, Escherichia coli STEC_94C
MKHKLQMMKMRWLSAAVMLTLYTSSSWAFSIDDVAKQAQSLAGKGYEAPKSNLPSVFRDMKYADYQQIQFNHDKAYWNNLKTPFKLEFYHQGMYFDTPVKINEVTATAVKRIKYSPDYFTFGDVQHDKDTVKDLGFAGFKVLYPINSKDKNDEIVSMLGASYFRVIGAGQVYGLSARGLAIDTALPSGEEFPRFKEFWIERPKPTDKRLTIYALLDSLRATGAYKFVVMPGRDTVVDVQSKIYLRDKVGKLGVAPLTSMFLFGPNQPSPANNYRPELHDSNGLSIHAGNGEWIWRPLNNPKHLAVSSFSMENPQGFGLLQRGRDFSRFEDLDDRYDLRPSAWVTPKGEWGKGSVELVEIPTNDETNDNIVAYWTPDQLPEPGKEMNFKYTITFSRDEDKLHAPDNAWVQQTRRSTGDVKQSNLIRQPDGTIAFVVDFTGAEMKKLPEDTPVTAQTSIGDNGEIVESTVRYNPVTKGWRLVMRVKVKDAKKTTEMRAALVNADQTLSETWSYQLPANE

SEQ ID NO: 22895 - protein, 232 aa, Escherichia coli STEC_94C; identical to SEQ ID NO: 5747

SEQ ID NO: 22896 - protein, 729 aa, Escherichia coli STEC_94C; identical to SEQ ID NO: 6500

SEQ ID NO: 22897 - protein, 213 aa, Escherichia coli STEC_94C; identical to SEQ ID NO: 5744

SEQ ID NO: 22898 - protein, 593 aa, Escherichia coli STEC_94C
MSVVVSGTLKSPDGEAISGANITLTALTVSPDALSGTSASAVTREGGYYGMTMDPGEYAVSVTVKGKTAVYGRVRIEGTESTVTLNMLLRRSLVEVSIPGELLTDFRQIQNNVADDLATIRRLNEDTTTKNTQATKSKESAEASAKSASDSAKTATSRAAEAGQKATDATEAATRAITAAGNAEESSTRAGESEKAAGADAEKARQHAEKARLAQESAGEILKRAEAATVSAEEARRMAENARGPQGPRGPQGETGPMGAQGPKGDTGAQGMQGLRGEAGPKGERGETGPAGPRGEKGVQGEPGPQGLQGLKGDTGARGAQGVPGPTGPMGPAGPRGETGPQGVQGPRGETGPVGPQGVPGIQGPAGPAGPRGETGARGEKGEPGDPGGPPGPKGDTGPRGEPGPQGPAGPRGPAGERGPQGLQGVAGERGDTGPAGPQGIPGPPGPTGSVGPKGEKGEPGDRGPQGATGPRGPQGEKGDKGDPGPAGPAGERGPKGDTGPTGPAGKDGADSQANRVRISEKTEVTSSTVVFPSFYGGAQGENAAPDGAVILNIRTAPVSLTNGNLGAACVTAVTYGFLQVHDGSQWVTVKHE

SEQ ID NO: 22899 - protein, 236 aa, Escherichia coli STEC_94C; identical to SEQ ID NO: 6472

SEQ ID NO: 22900 - protein, 700 aa, Escherichia coli STEC_94C
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDNGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 22901 - protein, 539 aa, Escherichia coli STEC_94C
MAAVCGTSGIASLFSQAAFAADSDIADGQTQRFDFSILQSMAHDLAQTTWRGAPRPLPDTLATMTPQAYNSIQYDAEKSLWHNVENRQLDAQFFHMGMGFRRRVRMFSVDPATHLAREIHFRPELFKYNDAGVDTKQLEGQSDLGFAGFRVFKAPELARRDVVSFLGASYFRAVDDTYQYGLSARGLAIDTYTDSKEEFPDFTAFWFDTVKPGATTFTVYALLDSASITGAYKFTIHCEKSQVIMDVENHLYARKDIKQLGIAPMTSMFSCGTNERRMCDTIHPQIHDSDRLSMWRGNGEWICRPLNNPQKLQFNAYTDNNPKGFGLLQLDRDFSHYQDIMGWYNKRPSLWVEPRNKWGKGTIGLMEIPTTGETLDNIVCFWQPEKAVKAGDEFAFQYRLYWSAQPPVHCPLARVMATRTGMGGFPEGWAPGEHYPEKWARRFAVDFVGGDLKAAAPKGIEPVITLSSGEAKQIEILYIEPIDGYRIQFDWYPTSDSTDPVDMRMYLRCQGDAISETWLYQYFPPAPDKRQYVDDRVMS

SEQ ID NO: 22902 - protein, 374 aa, Escherichia coli STEC_94C; identical to SEQ ID NO: 5608

SEQ ID NO: 22903 - protein, 196 aa, Escherichia coli STEC_94C; identical to SEQ ID NO: 9582

SEQ ID NO: 22904 - protein, 250 aa, Escherichia coli STEC_94C
MSDLLCSAKLGATTLALLLSAASLSAQASVTPDRTRLIFNESDKSISVTLRNNDPKLPYLAQSWIEDEKGNKISSPLTVLPPVQRIDSMMNGQVKVQGMPDINKLPADRESLFYFNVREIPPKSNKANTLQIALQTRIKLFWRPKALENVSMKNPWQYKVTLTRNGQEFTVNNPTPYYVIFSNASTQKNGNPAAGFSPIVMSPKTSAPLNVKMGSVPVLTYVNDYGARMSLFFTCNGNSCQVDEEQSRKG

SEQ ID NO: 22905 - protein, 880 aa, Escherichia coli STEC_94C; identical to SEQ ID NO: 10545

SEQ ID NO: 22906 - protein, 518 aa, Escherichia coli STEC_94C; identical to SEQ ID NO: 7565

SEQ ID NO: 22907 - protein, 89 aa, Escherichia coli STEC_94C; identical to SEQ ID NO: 6232

SEQ ID NO: 22908 - protein, 111 aa, Escherichia coli STEC_94C; identical to SEQ ID NO: 7885

SEQ ID NO: 22909 - protein, 118 aa, Escherichia coli STEC_94C [sequence omitted]

SEQ ID NO: 22910 - protein, 826 aa, Escherichia coli STEC_94C
MLRMTPLASAIVALLLGIEAYAAEETFDTHFMIGGMKAQQVANIRLDDNQPLPGQYDIDIYVNKQWRGKYEIIVKDNPQETCLSIEVIKRLGINSDNFASGKQCLTFEQLVQGGSYTWDIGVFRLDFSVPQAWVEELESGYVPPENWERGINAFYTSYYVSQYYSDYKASGNSKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRFGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSHSNNWRRISYILAASQAYDENHHEEKRFNIFISIPFDWGDDVTTPRRQIYMSNSTTFDDQGFASNNTGLSGTVGSRDQFNYGVNLSYQNQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRADGQPLMFGYEVNDIHGHNIGVVGQGSQLFIRTNEVPPSVNVAIDKQQGLSCTITFGKEIDESRNYICQ

SEQ ID NO: 22911 - protein, 224 aa, Escherichia coli STEC_94C
MKGLLSLLIFSMVLPAHAGIVIYGTRIIYPAENKEVMVQLMNQGNRSSLLQAWIDDGDTSLPPEKIQVPFMLTPPVAKIGANSGQQVKIKIMPNKLPTNKESIFYLNVLDIPPNSPEQEGKNALKFAMQNRIKLFYRPAGIAPVNKATFKKLLVNRSGNGLVIKNDSANWVTISDVKANNVKVNYETIMIAPLESQSVNVKSNNANNWYLSIIDDHGNYISDKI

SEQ ID NO: 22912 - protein, 641 aa, Escherichia coli STEC_94C; identical to SEQ ID NO: 7954

SEQ ID NO: 22913 - protein, 828 aa, Escherichia coli STEC_94C; identical to SEQ ID NO: 7891

SEQ ID NO: 22914 - protein, 162 aa, Escherichia coli STEC_94C; identical to SEQ ID NO: 5896

SEQ ID NO: 22915 - protein, 393 aa, Escherichia coli STEC_94C
MTVKISGVLKDGAGKPVPGCTIELKARRTTETVIVTTVAYGQSGETGSYSMDVEPGLYRVTLNTEGYAPSYVGDILVKAESAPGTLNKFLMDLEDAQYYPKALAELEAVAAEILKRAEASAASAEEAKKRAENARGPKGDKGDTGPQGIPGPKGDTGERGPKGERGEAGPQGVQGARGETGPVGPQGVPGIQGPAGPAGPRGETGARGEKGEPGDPGGPPGPKGDTGPRGEPGPQGPAGPRGPAGERGPQGLQGVAGERGDTGPAGPQGATGPRGPQGEKGDKGDPGPAGPAGERGPKGDTGPTGPAGKDGADSQANRVRISEKTEVTSSTVVFPSFYGGAQGENAAPEGAVILNIRTAPVSLTNGNLGAACVTAVTYGFLQVHDGRQWVTVE

SEQ ID NO: 22916 - protein, 432 aa, Escherichia coli STEC_94C; identical to SEQ ID NO: 5727

SEQ ID NO: 22917 - protein, 359 aa, Escherichia coli STEC_94C; identical to SEQ ID NO: 6332

SEQ ID NO: 22918 - protein, 675 aa, Escherichia coli STEC_94C
MAAEDVMIVSASGYEKKLTNAAASVSVISQEELQSSQYHDLAEALRAVEGVDVESGTGKTGGLEISIRGMPASYTLILIDGVRQGGSGDVTPNGFSAMNTGFMPPLAAIERIEVIRGPMSTLYGSDAMGGVVNIITKKNADKWLSSVNAGLNLQESNKWGNSSQFNFWSSGPLVDDSVSLQIRGSTQQRQGSSVTSLSDTSATRIPYPTESQNYNLGARIDWKATEQDVLWFDMDTTRQRYDNQDGQLGSLTGGYDHTLRYERNKISAGYDHTFTFGTWKSYLNWNETENKGRELVRSVLKSDKWGLAGKPRELKESNLILNSLLLTPLGESHLLTVGGEYQSSSMKDGVVLASTGETFRQKSWSLFAEDEWHLTDVLALTAGSRYEHHDQFGGHFSPRAYLVWDVTDAWTLKGGVTTGYKAPTMGQLHKGISGVSGQGRTNLLGNPELKPEESVSYEAGVYYDNLSGLNANITGFITDFSNKIVSYSIDDNTNSYTNSGKARLHGVEFAGTLPLWSEDVTLSLNYTWTQSEQRDGDNKGAPLSYTPEHMVNAKLNWQITEEVASWLGARYRGKTPRFTRNYSSLSAVQKKVYDEKGEYLKAWTVVDAGLSWKVTDALTLNAAVNNLLNKDYSDVSLYSAGKSTLYAGDYFQTGSSTTGYVIPERNYWMSLNYQF

SEQ ID NO: 22919 - protein, 614 aa, Escherichia coli STEC_94C
MIKKYWFLMVYSVTAFSVWAQDTPLDTLVVTANRFQEPLSTVLAPVTIVTREDIDRWQVSSVNDVLRRLPGVAISQHGGEGQLSTIFVRGTNSNHTLVLIDGVRLNLAGVSGAADLSQFPVALVQRIEYIRGPRSAIYGSDAIGGVINIITSRENTGTEISAGWGSNSYQHYDISTHQQLGENTRVTLLGDYTYTRGFDAVAYGSTGMQPQSDRDGFLSKTFYGKLEHNLSDTWSGFVRGYGYDNRTKYDAWYSPGSPLIDTRKLYSQSWDAGLRYAGETLQSQLVSSYSHSKDYNYDPHYGRYDTSANLDDMKQYNLQWTNSVTVGHGNVGAGIDWQKQSTTPGTGYLPKGYDQRNTGIYLTGLQKLGDFTLEGAVRNDDNSQFERHTTWQSSAGWEFIEGYRFIASYGTAFKAPNLGQLYGMYGNPNLAPEKSKQWEGAFEGLTGGVNWRISGYRNDISEMINYNPHTLRYYNDGKVHVKGIEATVNFDTGALTHTVSYDYTDARNALTDEPLERRPKLQVKYQLDWQVFDFDWGITYQYMGSRYDSDYSSWPYKSVKMGGVSLWDVAVAYPVTPHLIVRGKIANLFNKDYETGYGYQAAGREYILSGSYTF

SEQ ID NO: 22920 - protein, 834 aa, Escherichia coli STEC_94C; identical to SEQ ID NO: 8715

SEQ ID NO: 22921 - protein, 249 aa, Escherichia coli STEC_94C; identical to SEQ ID NO: 6450

SEQ ID NO: 22922 - protein, 615 aa, Escherichia coli STEC_94C; identical to SEQ ID NO: 10149

SEQ ID NO: 22923 - protein, 231 aa, Escherichia coli STEC_94C; identical to SEQ ID NO: 6351

SEQ ID NO: 22924 - protein, 721 aa, Escherichia coli STEC_94C
MDEIPALAEKDDDSVINSLEQIIPGTAAEFDFNHQRLNLSIPQIALYRDAKGYVSPSRWDDGIPTLFTNYSFTGSDNRYRQGNRSQRQYLNMQNGANFGPWRLRNYSTWTRNAQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPGFAEATAIYGLNNTFTLYGGLLGSEDYYALGIGIGGTLGALGALSMDINRADTQFDNRHSFHGYQWRTQYIKDIPETNTNIAVSYYRYTNDGYFSFDEANTRNWDYNSRQKSEIQFNISQTIFDGVSLYASGSQQDYWGNNDKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 22925 - protein, 678 aa, Escherichia coli STEC_94C
MVPSTFSRLKAARCLPVVLAALIFAGCGTHTPDQSTAYMQGTAQADSAFYLQQMQQSSDDTRINWQLLAIRALVKEGKTGQAVELFNQLPQELNDSQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGCTIQQGFEAAKNIGTQPVAAQVAAAPAADVAEQPQPQTVDGVASPAQASVSDLTGEQPAAQPAPVSTPAATTTAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGTPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 22926 - protein, 380 aa, Escherichia coli STEC_94C
MAQVLQALAEQEKLNLVVSPDVSGTVSLHLTDVPWKQALQTVVKSAGLITRQEGNILSVHSIAWQNDNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 22927 - protein, 243 aa, Escherichia coli STEC_94C; identical to SEQ ID NO: 15477

SEQ ID NO: 22928 - protein, 208 aa, Escherichia coli STEC_94C
MKKIWLALAGLVLAFSASAAQYEDGKQYTSLEKPVAGAPQVLEFFSFFCPHCYQFEEVLHISDNVKKKLPEGVKMTKYHVNFMGGDLGKDLTQAWAVAMALGVEDKVTVPLFEGVQKTQTIRSASDIRDVFINAGIKGEEYDAAWNSFVVKSLVAQQEKAAADVQLRGVPAMFVNGKYQLNPQGMDTSNMDVFVQQYADTVKYLSEKK

SEQ ID NO: 22929 - protein, 614 aa, Escherichia coli STEC_94C; identical to SEQ ID NO: 7971

SEQ ID NO: 22930 - protein, 446 aa, Escherichia coli STEC_94C; identical to SEQ ID NO: 8470

SEQ ID NO: 22931 - protein, 89 aa, Escherichia coli STEC_94C; identical to SEQ ID NO: 6177

SEQ ID NO: 22932 - protein, 237 aa, Escherichia coli STEC_94C; identical to SEQ ID NO: 6533

SEQ ID NO: 22933 - protein, 368 aa, Escherichia coli STEC_94C; identical to SEQ ID NO: 7974

SEQ ID NO: 22934 - protein, 241 aa, Escherichia coli STEC_94C; identical to SEQ ID NO: 6135

SEQ ID NO: 22935 - protein, 837 aa, Escherichia coli STEC_94C
MSSAELYFNPRFLADDPQAVADLSRFENGQELPPGTYRVDIYLNNGYMATRDVTFNTGDSEQGIVPCLTRAQLASMGLNTASVSGMNLLADDACVPLTSIIHDATAHLDVGQQRLNLTIPQAFMSNRARGYIPPELWDPGINAGLLNYNFSGNSVQNRIGGNSHYAYLNLQSGLNIGAWRLRDNTSWSYNSSDRSSGSKNKWQHINTWLERDIIPLRSRLTLGDGYTQGDIFDGINFRGAQLASDDNMLPDSQRGFAPVILGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNNGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 22936 - protein, 747 aa, Escherichia coli STEC_B2F1; identical to SEQ ID NO: 6343

SEQ ID NO: 22937 - protein, 266 aa, Escherichia coli STEC_B2F1; identical to SEQ ID NO: 5772

SEQ ID NO: 22938 - protein, 161 aa, Escherichia coli STEC_B2F1; identical to SEQ ID NO: 5769

SEQ ID NO: 22939 - protein, 351 aa, Escherichia coli STEC_B2F1; identical to SEQ ID NO: 6367

SEQ ID NO: 22940 - protein, 222 aa, Escherichia coli STEC_B2F1; identical to SEQ ID NO: 10109

SEQ ID NO: 22941 - protein, 869 aa, Escherichia coli STEC_B2F1; identical to SEQ ID NO: 9082

SEQ ID NO: 22942 - protein, 365 aa, Escherichia coli STEC_B2F1; identical to SEQ ID NO: 7931

SEQ ID NO: 22943 - protein, 746 aa, Escherichia coli STEC_B2F1
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINLGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPLDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 22944 - protein, 193 aa, Escherichia coli STEC_B2F1; identical to SEQ ID NO: 6300

SEQ ID NO: 22945 - protein, 243 aa, Escherichia coli STEC_B2F1; identical to SEQ ID NO: 8324

SEQ ID NO: 22946 - protein, 819 aa, Escherichia coli STEC_B2F1
MDTVNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINQCVDFSSRPEMLFNFDQANQQLNITIPQAWLAWHSENWTPPSTWKEGVAGVLMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPVISSYQPSTVAVNMNDLPDGVTVAENVIKETWIEGAIGYKSLASRSGKDVNVIIRNASGQFPPLGADIRQDDSGISVGMVGEKGHAWLSGVAENQKFTVVWGDSQHCSLHLPEHMEDTANRLILPCH

SEQ ID NO: 22947 - protein, 430 aa, Escherichia coli STEC_B2F1; identical to SEQ ID NO: 5758

SEQ ID NO: 22948 - protein, 331 aa, Escherichia coli STEC_B2F1; identical to SEQ ID NO: 6456

SEQ ID NO: 22949 - protein, 760 aa, Escherichia coli STEC_B2F1; identical to SEQ ID NO: 6322

SEQ ID NO: 22950 - protein, 203 aa, Escherichia coli STEC_B2F1; identical to SEQ ID NO: 6414

SEQ ID NO: 22951 - protein, 361 aa, Escherichia coli STEC_B2F1; identical to SEQ ID NO: 7868

SEQ ID NO: 22952 - protein, 224 aa, Escherichia coli STEC_B2F1; identical to SEQ ID NO: 7869

SEQ ID NO: 22953 - protein, 866 aa, Escherichia coli STEC_B2F1
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKNYAWMTSNTSIDNEGHITQNLGLTETLLDDGNLSYSVQQGYNSEGKTANGSASMDYKGAFADARVGYNYSDNGSQQQLNYALSGSLVAHSLGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGIQTNSGIIDDDGSLYMSGLPAQGAITVRWGEAPDQICHISYQLTEQQINSAITRMDAICR

SEQ ID NO: 22954 - protein, 229 aa, Escherichia coli STEC_B2F1; identical to SEQ ID NO: 9369

SEQ ID NO: 22955 - protein, 552 aa, Escherichia coli STEC_B2F1
MTVKISGVLKDGAGKPVPGCTIELKARRTTETVIVTTVAYGQPGETGSYSMDVEPGLYRVTLNTEGYAPSYVGDILVKAESAPGTLNKFLMDLEDAQYYPKALAELEAVAAEILKRAEASAASAEEAKKRAENARGPKGDKGDTGPQGIPGPKGDTGERGPKGERGEAGPQGVQGPRGETGPVGPQGEAGIQGPAGPAGPRGETGARGEKGEPGDPGGPPGPKGDTGPRGVPGPQGPAGPRGPAGERGPQGLQGVAGERGDTGPAGPQGATGPRGPQGEKGGKGDPGPAGPAGERGPQGERGATGPVGPQGPAGPAGKSASLDDIADKEAFIRKLGVARAYGRDLKTGEGEWTTEEFINWLKSQGAFEGPYWVMTTTRLLNSNRVITDVDTDLGKKKITLRGCAIEVMGSWENAIVRINAGDDRPWDMFYGTDCTCVVSGSIKSYEWRFNYTSIRRPSTAKLDVNGWERDEATGRIRQWGQKQVVRPTSEGDTHTIYFPIAFPSAALNVIVSPVGSPGNFTGYALSEPLLKSVILTVSKDTYGLFYWEAIGY

SEQ ID NO: 22956 - protein, 191 aa, Escherichia coli STEC_B2F1; identical to SEQ ID NO: 5748

SEQ ID NO: 22957 - protein, 232 aa, Escherichia coli STEC_B2F1; identical to SEQ ID NO: 5747

SEQ ID NO: 22958 - protein, 729 aa, Escherichia coli STEC_B2F1; identical to SEQ ID NO: 5745

SEQ ID NO: 22959 - protein, 213 aa, Escherichia coli STEC_B2F1; identical to SEQ ID NO: 5744

SEQ ID NO: 22960 - protein, 565 aa, Escherichia coli STEC_B2F1; identical to SEQ ID NO: 6492

SEQ ID NO: 22961 - protein, 207 aa, Escherichia coli STEC_B2F1; identical to SEQ ID NO: 5743

SEQ ID NO: 22962 - protein, 89 aa, Escherichia coli STEC_B2F1; identical to SEQ ID NO: 6053

SEQ ID NO: 22963 - protein, 700 aa, Escherichia coli STEC_B2F1; identical to SEQ ID NO: 7945

SEQ ID NO: 22964 - protein, 539 aa, Escherichia coli STEC_B2F1; identical to SEQ ID NO: 6525

SEQ ID NO: 22965 - protein, 422 aa, Escherichia coli STEC_B2F1
MTVKISGVLKDGAGKPVPGCTIELKARRTTETVIVTTVAYGQPGETGSYSMDVEPGLYRVTLNTEGYAPSYVGDILVKADSAPGTLNKFLMDLEDAQYYPKALAELEAVAAEILKRAEASAASAEEAKKRAENARGPKGDKGDTGPQGIPGPKGDTGERGPKGERGEAGPQGVQGPRGETGPVGPQGEAGIQGPAGPAGPRGETGARGEKGEPGDPGGPPGPKGDTGPRGEPGPQGPAGPRGPAGERGPQGLQGVAGERGDTGPAGPQGIPGPPGPTGSVGPKGEKGEPGDRGPQGATGPRGPQGEKGDKGDPGPAGPAGERGPKGDTGPTGPAGKDGADSQANRVRISEKTEVTSSTVVFPSFYGGAQGENAAPDGAVILNIRTAPVSLTNGNLGAACVTAVTYGFLQVHDGSQWVTVEHE

SEQ ID NO: 22966 - protein, 353 aa, Escherichia coli STEC_B2F1
MNERELSIIRALGEEFSAVLADLQRTFEGKIAAQAQTFEEKLASLSVVLQKCVTGDDVRPMLEQMVKEAVSHIPVPRDGRDYDPDVLQKAVNDAVGKIPVPANGKSITPDDVRPMIEQMVKEAVSHIPVPRDGRDYDPDVLQKAVNDAVANIPLPADGKSITPDDVHPMLEQMVKVAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTGDKPGEAHSSAWTLAAKRGRDAGGGK

SEQ ID NO: 22967 - protein, 118 aa, Escherichia coli STEC_B2F1 [sequence omitted]

SEQ ID NO: 22968 - protein, 236 aa, Escherichia coli STEC_B2F1; identical to SEQ ID NO: 6472

SEQ ID NO: 22969 - protein, 102 aa, Escherichia coli STEC_B2F1
MKKVLALVVAAAMGLSSTAFAAETATTPAPTATTTKAAPAKTTHHKKQHKAAPAQKAQAAKKHHKNTKAEQKAPEQKAQAAKKHAGKHSHQQPAKPAAQPAA

SEQ ID NO: 22970 - protein, 826 aa, Escherichia coli STEC_B2F1; identical to SEQ ID NO: 7342

SEQ ID NO: 22971 - protein, 224 aa, Escherichia coli STEC_B2F1; identical to SEQ ID NO: 6302

SEQ ID NO: 22972 - protein, 631 aa, Escherichia coli STEC_B2F1
MVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTVINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 22973 - protein, 828 aa, Escherichia coli STEC_B2F1; identical to SEQ ID NO: 6558

SEQ ID NO: 22974 - protein, 162 aa, Escherichia coli STEC_B2F1; identical to SEQ ID NO: 5896

SEQ ID NO: 22975 - protein, 367 aa, Escherichia coli STEC_B2F1; identical to SEQ ID NO: 5796

SEQ ID NO: 22976 - protein, 200 aa, Escherichia coli STEC_B2F1; identical to SEQ ID NO: 6311

SEQ ID NO: 22977 - protein, 274 aa, Escherichia coli STEC_B2F1; identical to SEQ ID NO: 8357

SEQ ID NO: 22978 - protein, 250 aa, Escherichia coli STEC_B2F1; identical to SEQ ID NO: 6317

SEQ ID NO: 22979 - protein, 881 aa, Escherichia coli STEC_B2F1; identical to SEQ ID NO: 8359

SEQ ID NO: 22980 - protein, 518 aa, Escherichia coli STEC_B2F1; identical to SEQ ID NO: 6358

SEQ ID NO: 22981 - protein, 360 aa, Escherichia coli STEC_B2F1
MMKKYLALALIAPLLISCSTTKKGDTYNEAWVKDTNGFDILMGQFAHNIENIWGFKEVVIAGPKDYVKYTDQYQTRSHINFDDGTITIETIAGAEPAAHLRRAIIKTLLMGDDPSSVDLYSDVDDITISKEPFLYGQVVDNTGQPIRWEGRASNFADYLLKNRLQSRSNGLRIIYSVTINMVPNHLDKRAHKYLGMVRQASRKYGVDESLILAIMQTESSFNPYAVSRSDALGLMQVVQHTAGKDVFRSQGKSGTPSRSFLFDPASNIDTGTAYLAMLNNVYLGGIDNPTSRRYAVITAYNGGAGSVLRVFSNDKIQAANIINTMTPGDVYQTLTTRHPSAESRRYLYKVNTAQKSYRRR

SEQ ID NO: 22982 - protein, 675 aa, Escherichia coli STEC_B2F1
MAAEDVMIVSASGYEKKLTNAAASVSVISQEELLSSQYHDLAEALRAVEGVDVESGTGKTGGLEISIRGMPASYTLILIDGVRQGGSGDVTPNGFSAMNTGFMPPLAAIERIEVIRGPMSTLYGSDAMGGVVNIITKKNADKWLSSVNAGLNLQESNKWGNSSQFNFWSSGPLVDDSVSLQIRGSTQQRQGSSVTSLSDTSATRIPYPTESQNYNLGARIDWKATEQDVLWFDMDTTRQRYDNQDGQLGSLTGGYDHTLRYERNKISAGYDHTFTFGTWKSYLNWNETENKGRELVRSVLKSDKWGLAGKPRELKESNLILNSLLLTPLGESHLLTVGGEYQSSSMKDGVVLASTGETFRQKSWSLFAEDEWHLTDVLALTAGSRYEHHDQFGGHFSPRAYLVWDVTDAWTLKGGVTTGYKAPTMGQLHKGISGVSGQGRTNLLGNPELKPEESVSYEAGVYYDNLSGLNANITGFITDFSNKIVSYSIDDNTNSYTNSGKARLHGVEFAGTLPLWSEDVTLSLNYTWTQSEQRDGDNKGAPLSYTPEHMVNAKLNWQITEEVASWLGARYRGKTPRFTRNYSSLSAVQKKVYDEKGEYLKAWTVVDAGLSWKVTDALTLNAAVNNLLNKDYSDVSLYSAGKSTLYAGDYFQTGSSTTGYVIPERNYWMSLNYQF

SEQ ID NO: 22983 - protein, 686 aa, Escherichia coli STEC_B2F1; identical to SEQ ID NO: 6339

SEQ ID NO: 22984 - protein, 834 aa, Escherichia coli STEC_B2F1; identical to SEQ ID NO: 8715

SEQ ID NO: 22985 - protein, 249 aa, Escherichia coli STEC_B2F1; identical to SEQ ID NO: 6450

SEQ ID NO: 22986 - protein, 199 aa, Escherichia coli STEC_B2F1; identical to SEQ ID NO: 7966

SEQ ID NO: 22987 - protein, 806 aa, Escherichia coli STEC_B2F1; identical to SEQ ID NO: 14187

SEQ ID NO: 22988 - protein, 678 aa, Escherichia coli STEC_B2F1; identical to SEQ ID NO: 9900

SEQ ID NO: 22989 - protein, 432 aa, Escherichia coli STEC_B2F1; identical to SEQ ID NO: 5727

SEQ ID NO: 22990 - protein, 386 aa, Escherichia coli STEC_B2F1; identical to SEQ ID NO: 7993

SEQ ID NO: 22991 - protein, 840 aa, Escherichia coli STEC_B2F1
MHLPLYHYRAHFSFSLLALTIASSLPAYGGKFNPKFLENVQGIDQHIDLSVYDSPVGQQIPGKYRVSVFVNEEKMASRTLDFSTASEAKRKASGESLMPCLSRVQLEEMGVRVDSFPALKMSPPEACVAFDEIIPQATSRFDFNTQTLHLSFPQAAMMMTARGTVDPSRWDEGIPALLLDYSFSGSNGRNEGTGSSSDSTSDSYYLNLRSGLNVGPWRLRNNSIWNRTDGKNQWDNVGTSLNRAIIPLKSQITLGDTATPGEIFDSVQMRGALLASDDEMLPDSQRGFAPVVRGIAKSNAEVSIEQNGYVIYRTFVQPGAFEINDLYATSGSGDLTVIIKEADGSEQRFIQPFSAVAIFQREGYLKYSLAAGEYRAGNYDSDKPHFGQFTAMYGLPWGMTAYGGALLSADYSALALGLGKNFGTIGAVSVDVTQAKSQLRNNEKEEGQSYRFLYSKSFEGGTDLRLLGYKYSTSGYYTFQEATDVRSDADSDYRRYHKRSQIQGNITQQLGDYGSVYFNMTQQDYWNVDGKENSLSAGYHGHIGRVNYSVAYTWTRSPEWEEDDRLWSFSVSIPLGGAWSSYRMTTDQNGKTSQQASVSGTLLEDRNLSYNVQQGYTSNGVGYSGSVNMGYMGGSGNIDVGYNYSKDNQQVNYGVRGGVIVHSEGITLSQPLGESLAIVSAPGARGGHVVNSSGVEVDWMGNAVVPYLTPYRETIVELRSDTLGQNVELQEAFQKVVPTRGAVVRSRFDTRVGYRVLMSLKQANGNAVPFGATAALIDESKPASSIVGEEGQLYISGMPEEGELQVSWGNEQAQRCRVPFRLPENKDNAAIVMVNAVCEK

SEQ ID NO: 22992 - protein, 228 aa, Escherichia coli STEC_B2F1; identical to SEQ ID NO: 6185

SEQ ID NO: 22993 - protein, 243 aa, Escherichia coli STEC_B2F1; identical to SEQ ID NO: 6145

SEQ ID NO: 22994 - protein, 208 aa, Escherichia coli STEC_B2F1; identical to SEQ ID NO: 5717

SEQ ID NO: 22995 - protein, 614 aa, Escherichia coli STEC_B2F1; identical to SEQ ID NO: 7971

SEQ ID NO: 22996 - protein, 446 aa, Escherichia coli STEC_B2F1; identical to SEQ ID NO: 6459

SEQ ID NO: 22997 - protein, 237 aa, Escherichia coli STEC_B2F1; identical to SEQ ID NO: 6313

SEQ ID NO: 22998 - protein, 368 aa, Escherichia coli STEC_B2F1; identical to SEQ ID NO: 7974

SEQ ID NO: 22999 - protein, 218 aa, Escherichia coli STEC_B2F1
MFMAMMVAGRAEAGVALGATRVIYPAGQKQVQLAVTNNDENSTYLIQSWVENADGVKDGRFIVTPPLFAMKGKRENTLRILDATNNQLPQDRESLFWMNVKAIPSMDKSKLTENTLQLAIISRIKLYYRPAKLALPPDQAAEKLRFRRSANSLTLINPTPYYLTVTELNAGTRVLENALVPPMGESTVKFPSDAGSNITYRTINDYGALTPKMTGVME

SEQ ID NO: 23000 - protein, 856 aa, Escherichia coli STEC_B2F1; identical to SEQ ID NO: 16323

SEQ ID NO: 23001 - protein, 784 aa, Escherichia coli STEC_B2F1; identical to SEQ ID NO: 6283

SEQ ID NO: 23002 - protein, 170 aa, Escherichia coli STEC_B2F1 [sequence omitted]

SEQ ID NO: 23003 - protein, 866 aa, Escherichia coli STEC_B2F1; identical to SEQ ID NO: 7345

SEQ ID NO: 23004 - protein, 230 aa, Escherichia coli STEC_B2F1; identical to SEQ ID NO: 7855

SEQ ID NO: 23005 - protein, 816 aa, Escherichia coli STEC_C165-02; identical to SEQ ID NO: 14730

SEQ ID NO: 23006 - protein, 227 aa, Escherichia coli STEC_C165-02; identical to SEQ ID NO: 8084

SEQ ID NO: 23007 - protein, 784 aa, Escherichia coli STEC_C165-02; identical to SEQ ID NO: 6283

SEQ ID NO: 23008 - protein, 170 aa, Escherichia coli STEC_C165-02
MSGILTRWRQFGKRYFWPHLLLGMVAASLGLPALSNAAEPNAPAKATTRNHEPSAKVNFGQLALLEANTRRPNSNYSVDYWHQHAIRTVIRHLSFAMAPQTLPVAEESLPLQAQHLALLDTLSALLTQEGTPSEKGYRIDYAHFTPQAKFSMPVWISQAQGIRAGPQRLS

SEQ ID NO: 23009 - protein, 446 aa, Escherichia coli STEC_C165-02; identical to SEQ ID NO: 6459

SEQ ID NO: 23010 - protein, 237 aa, Escherichia coli STEC_C165-02; identical to SEQ ID NO: 6384

SEQ ID NO: 23011 - protein, 368 aa, Escherichia coli STEC_C165-02
MNKTITALTIIMASFAANASVLPETPVPFKSGTGAIDNDTVYIGLGSAGTAWYKLDTQAKDKKWTALAAFPGGPRDQATSAFIDGNLYVFGGIGKNSEGLTQVFNDVHKYNPKTNSWVKLMSHAPMGMAGHVTFVHNGKAYVTGGVNQNIFNGYFEDLNEAGKDSTAIDKINAHYFDKKAEDYFFNKFLLSFDPSTQQWSYAGESPWYGTAGAAVVSKGDKTWLINGEAKPGLRTDAVFELDFTGNNLKWNKLAPVASPDGVAGGFAGMSNDSLIFAGGAGFKGSRENYQNGKNYAHEGLKKSYSADIHLWHNGKWDKSGELSRGRAYGVSLPWNNSLLIIGGETAGGKAVTDSVLISVKDNKVTVQN

SEQ ID NO: 23012 - protein, 241 aa, Escherichia coli STEC_C165-02; identical to SEQ ID NO: 6143

SEQ ID NO: 23013 - protein, 856 aa, Escherichia coli STEC_C165-02
MAGFFVRLFVACAFAAQSPLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAQLDVGQQRLNLTIPQAFMSNRARGYIPPELWDPGINAGLLNYNFSGNSVQNRIGGNSHYAYLNLQSGLNIGAWRLRDNTTWSYNSSDSSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDTKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 23014 - protein, 866 aa, Escherichia coli STEC_C165-02; identical to SEQ ID NO: 14734

SEQ ID NO: 23015 - protein, 243 aa, Escherichia coli STEC_C165-02; identical to SEQ ID NO: 14735

SEQ ID NO: 23016 - protein, 752 aa, Escherichia coli STEC_C165-02; identical to SEQ ID NO: 7439

SEQ ID NO: 23017 - protein, 266 aa, Escherichia coli STEC_C165-02; identical to SEQ ID NO: 8089

SEQ ID NO: 23018 - protein, 161 aa, Escherichia coli STEC_C165-02; identical to SEQ ID NO: 5769

SEQ ID NO: 23019 - protein, 230 aa, Escherichia coli STEC_C165-02; identical to SEQ ID NO: 14749

SEQ ID NO: 23020 - protein, 869 aa, Escherichia coli STEC_C165-02
MKIPTTTDIPQRYTWCLAGICYSSLAILPSFLSYAESYFNPAFLLENGTSVADLSRFERGNHQPAGVYRVDLWRNDEFIGSQDIVFESTTVNTGDKSGGLMPCFNQALLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDEPIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQATYGTLGVGYNYDRDQHDVNWQLSGGVVGHENGITLSQPLGDTNVLIKAPSAGGVRIENQTGILTDWRGYAVMPYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 23021 - protein, 746 aa, Escherichia coli STEC_C165-02; identical to SEQ ID NO: 8052

SEQ ID NO: 23022 - protein, 193 aa, Escherichia coli STEC_C165-02; identical to SEQ ID NO: 6300

SEQ ID NO: 23023 - protein, 243 aa, Escherichia coli STEC_C165-02; identical to SEQ ID NO: 14754

SEQ ID NO: 23024 - protein, 816 aa, Escherichia coli STEC_C165-02; identical to SEQ ID NO: 14755

SEQ ID NO: 23025 - protein, 430 aa, Escherichia coli STEC_C165-02; identical to SEQ ID NO: 5758

SEQ ID NO: 23026 - protein, 331 aa, Escherichia coli STEC_C165-02; identical to SEQ ID NO: 6551

SEQ ID NO: 23027 - protein, 191 aa, Escherichia coli STEC_C165-02; identical to SEQ ID NO: 14762

SEQ ID NO: 23028 - protein, 232 aa, Escherichia coli STEC_C165-02; identical to SEQ ID NO: 5747

SEQ ID NO: 23029 - protein, 729 aa, Escherichia coli STEC_C165-02; identical to SEQ ID NO: 8069

SEQ ID NO: 23030 - protein, 213 aa, Escherichia coli STEC_C165-02; identical to SEQ ID NO: 5744

SEQ ID NO: 23031 - protein, 203 aa, Escherichia coli STEC_C165-02; identical to SEQ ID NO: 6347

SEQ ID NO: 23032 - protein, 656 aa, Escherichia coli STEC_C165-02; identical to SEQ ID NO: 14767

SEQ ID NO: 23033 - protein, 565 aa, Escherichia coli STEC_C165-02
MKSPAPSRPQKMALIPACIFLCFAALSVQAEETSVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSLSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRASKMATATKTHLLQPGGLNTTSVKSGQQWDAPNGWAPLQWVATEGLQNYGQNEVAMDISWHFLTNVQHTYDREKKLVEKYDVSTTGTGGGGGEYPLQDGFGWTNGVTLKMLDLICPKEQPCDNVPATRPLSESTTQPVKQKEAEPTP

SEQ ID NO: 23034 - protein, 190 aa, Escherichia coli STEC_C165-02
MLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 23035 - protein, 539 aa, Escherichia coli STEC_C165-02; identical to SEQ ID NO: 6525

SEQ ID NO: 23036 - protein, 700 aa, Escherichia coli STEC_C165-02
MKIFSVRQTVLPALLVLSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVITQTGQQPPTIEASSYYGSFGSWRYGLKATGAMGDGTQPGDVDYTVSTTRFTTHGYRDHSGAQKNLANAKLGVRIDDASKLSLIFNSVDIKADDPGGLTEAEWKANPQQAPRAEQYDTRKTIKQTQAGLRYERSLSAQDDMSVMMYAGERETTQYQSIPMAPQLNPSHAGGVITLQRHYQGIDSRWTHRGELGVPLTFTTGLNYENMSENRKGYNNFRLNSGVPEYGQKGELRRDERNLMWNVDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVKASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPAPGRNYGVGMNIAWRFE

SEQ ID NO: 23037 - protein, 366 aa, Escherichia coli STEC_C165-02; identical to SEQ ID NO: 7432

SEQ ID NO: 23038 - protein, 203 aa, Escherichia coli STEC_C165-02; identical to SEQ ID NO: 6414

SEQ ID NO: 23039 - protein, 361 aa, Escherichia coli STEC_C165-02; identical to SEQ ID NO: 22858

SEQ ID NO: 23040 - protein, 118 aa, Escherichia coli STEC_C165-02 [sequence omitted]

SEQ ID NO: 23041 - protein, 392 aa, Escherichia coli STEC_C165-02
MKRKVLAMLVPALLVAGAANAAEVYNKDGNKLDLYGKVAGLHYFSDDAGSDGDMSYARIGFKGETQIADQFTGYGQWEFNIGANGPESDKGNTATRLAFAGLGFGQNGTFDYGRNYGVVYDIEAWTDMLPEFGGDTYAGADNFMNGRANGVATYRNNGFFGQVDGLNFALQYQGNNEDDGLFGQEGSGNGNGRKLAKENGDGFGMSTSYDFDFGLSLGAAYSNSDRTDNQVHKGWHNTRDGDRSDTTAGGETAEAWTVGAKYDANNVYLAAMYAETRNMTGYGKADAIANKTQNFEVVAQYQFDFGLRPSIAYLQSKGKDLGGWAHDGNGDPRYTNKDLVKYVDIGATYYFNKNMSTYVDYKINLLDNDDDFYEANGIATDDIVAVGLVYQF

SEQ ID NO: 23042 - protein, 236 aa, Escherichia coli STEC_C165-02; identical to SEQ ID NO: 14777

SEQ ID NO: 23043 - protein, 111 aa, Escherichia coli STEC_C165-02; identical to SEQ ID NO: 8631

SEQ ID NO: 23044 - protein, 89 aa, Escherichia coli STEC_C165-02; identical to SEQ ID NO: 6112

SEQ ID NO: 23045 - protein, 826 aa, Escherichia coli STEC_C165-02
MLRMTPLASAIVALLLGIEAYAAEETFDTHFMIGGMKDQQVANIRLDDNQPLPGQYDIDIYVNKQWRGKYEIIVKDNPQETCLSREIIKRLGINTDNFASGKQCLTFEQLVQGGSYTWDIGVFRLDFSVPQAWVEELESGYVPPENWERGINAFYTSYYVGQYYSDYKASGNSKSTYVRFNSGLNLLGWQLHSDASFSKTNSNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTSWNTRIGAISVDATKSHSKQDNGDVFDGQSYQIAYNKFVSQTSTRFGLAAWRYSSRDYRTFNDHVWANNKDNYRRDENDIYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVTTPRRQIYMSNSTTFDDQGFASNNTGLSGTVGNRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVVYDGMTPYRENHLMLDVSQSDSEAELRGNRKIAAPYRGAVVLVNFDTDQRKPWFIKALRTDGQPLTFGYEVNDIHGHNIGVVGQGSQLFIRTNEVPPSVNVAIDKQQGLSCTITFGKEIDESRNYICQ

SEQ ID NO: 23046 - protein, 224 aa, Escherichia coli STEC_C165-02; identical to SEQ ID NO: 14779

SEQ ID NO: 23047 - protein, 637 aa, Escherichia coli STEC_C165-02
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGDTPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGGESSVTVFRNDVKDRISISRTSDVNAAPGYQNFVGFTANGVPVFSYYNVNKARIQGVETELKIPFNDEWKLSLNYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 23048 - protein, 828 aa, Escherichia coli STEC_C165-02; identical to SEQ ID NO: 6558

SEQ ID NO: 23049 - protein, 162 aa, Escherichia coli STEC_C165-02; identical to SEQ ID NO: 5896

SEQ ID NO: 23050 - protein, 367 aa, Escherichia coli STEC_C165-02; identical to SEQ ID NO: 14784

SEQ ID NO: 23051 - protein, 200 aa, Escherichia coli STEC_C165-02; identical to SEQ ID NO: 7474

SEQ ID NO: 23052 - protein, 274 aa, Escherichia coli STEC_C165-02; identical to SEQ ID NO: 8098

SEQ ID NO: 23053 - protein, 249 aa, Escherichia coli STEC_C165-02; identical to SEQ ID NO: 8118

SEQ ID NO: 23054 - protein, 879 aa, Escherichia coli STEC_C165-02; identical to SEQ ID NO: 14788

SEQ ID NO: 23055 - protein, 518 aa, Escherichia coli STEC_C165-02; identical to SEQ ID NO: 6358

SEQ ID NO: 23056 - protein, 432 aa, Escherichia coli STEC_C165-02; identical to SEQ ID NO: 5727

SEQ ID NO: 23057 - protein, 567 aa, Escherichia coli STEC_C165-02; identical to SEQ ID NO: 6075

SEQ ID NO: 23058 - protein, 359 aa, Escherichia coli STEC_C165-02; identical to SEQ ID NO: 6332

SEQ ID NO: 23059 - protein, 678 aa, Escherichia coli STEC_C165-02; identical to SEQ ID NO: 14797

SEQ ID NO: 23060 - protein, 686 aa, Escherichia coli STEC_C165-02
MFWRDITLSVWRKKTTGLKTKKRLLPLVLAAALCSSPVQAEEATFTANFKDTDLKSFIETVGANLNKTIIMGPGVQGKVSIRTMTPLNERQYYQLFLNLLEAQGYAVVPMENDVLKVVKSSAAKVEPLPLIGEGSDNYAGDEMVTKVVPVRNVSVRELAPILRQMIDSAGSGNVVNYDPSNVIMLTGRASVVERLTEVIQRVDHAGNRTEEVIPLDNASASEIARVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREVVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKEKRNLMVFIRPTILRDGMAADGVSQRKYNYMRAEQIYRDEQGLSLMPNTAQPVLPAQNQALPPEVRAFLNAGRTR

SEQ ID NO: 23061 - protein, 713 aa, Escherichia coli STEC_C165-02
MAMFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYGDNQARVTAYDATTGTLTRRVDATQGSTQRMHATRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 23062 - protein, 222 aa, Escherichia coli STEC_C165-02; identical to SEQ ID NO: 14796

SEQ ID NO: 23063 - protein, 386 aa, Escherichia coli STEC_C165-02; identical to SEQ ID NO: 16912

SEQ ID NO: 23064 - protein, 259 aa, Escherichia coli STEC_C165-02; identical to SEQ ID NO: 8094

SEQ ID NO: 23065 - protein, 250 aa, Escherichia coli STEC_C165-02; identical to SEQ ID NO: 6119

SEQ ID NO: 23066 - protein, 629 aa, Escherichia coli STEC_C165-02
MTVTATGNARSSFEAPMMVSVIDTSAPENQTATSATDLLRHVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGTRLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 23067 - protein, 243 aa, Escherichia coli STEC_C165-02; identical to SEQ ID NO: 14800

SEQ ID NO: 23068 - protein, 614 aa, Escherichia coli STEC_C165-02; identical to SEQ ID NO: 14804

SEQ ID NO: 23069 - protein, 208 aa, Escherichia coli STEC_C165-02; identical to SEQ ID NO: 5717

SEQ ID NO: 23070 - protein, 784 aa, Escherichia coli STEC_DG131-3; identical to SEQ ID NO: 6283

SEQ ID NO: 23071 - protein, 170 aa, Escherichia coli STEC_DG131-3
MSGILTRWRQFGKRYFWPHLLLGMVAASLGLPALSNAAEPNAPAKATTRNHEPSAKVNFGQLVLLEANTRRPNSNYSVDYWHQHAIRTVIRHLSFAMAPQTLPVAEESLPLQAQHLALLDTLSALLTQEGTPSEKGYRIDYAHFTPQAKFSTPVWISQAQGIRAGPQRLT

SEQ ID NO: 23072 - protein, 765 aa, Escherichia coli STEC_DG131-3; identical to SEQ ID NO: 9418

SEQ ID NO: 23073 - protein, 230 aa, Escherichia coli STEC_DG131-3; identical to SEQ ID NO: 7855

SEQ ID NO: 23074 - protein, 368 aa, Escherichia coli STEC_DG131-3; identical to SEQ ID NO: 7974

SEQ ID NO: 23075 - protein, 241 aa, Escherichia coli STEC_DG131-3; identical to SEQ ID NO: 6138

SEQ ID NO: 23076 - protein, 863 aa, Escherichia coli STEC_DG131-3
MHIRKHRLAGFFVRLFVACAFAAQATLSSAELYFNPRFLADDPQAVADLSRFENGQELPPGTYRVDIYLNNGYMATRDVTFNTGDSEQGIVPCLTRAQLASMGLNTASVSGMNLLADDACVPLTSMIHDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGVQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKPRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNETVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 23077 - protein, 729 aa, Escherichia coli STEC_DG131-3; identical to SEQ ID NO: 12984

SEQ ID NO: 23078 - protein, 266 aa, Escherichia coli STEC_DG131-3; identical to SEQ ID NO: 5772

SEQ ID NO: 23079 - protein, 161 aa, Escherichia coli STEC_DG131-3; identical to SEQ ID NO: 5769

SEQ ID NO: 23080 - protein, 351 aa, Escherichia coli STEC_DG131-3
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGISDEDLVNYIDVGATYYFNKNMSAFVDYKINQLDSDNKLNINNDDIVAVGMTYQF

SEQ ID NO: 23081 - protein, 230 aa, Escherichia coli STEC_DG131-3; identical to SEQ ID NO: 6294

SEQ ID NO: 23082 - protein, 619 aa, Escherichia coli STEC_DG131-3
MGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADDSRHEGDSIRFLYAKSMNTFGTNFQLMGYRYSTQGFYTLDDVAYRRMEGYEYDYDYDGEHRDELIIVNYHNLRFSRKDRLQLNISQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQDDTSNNGYTGSATANWQATYGTLGVGYNYDRDQHDVNWQLSGGVVGHENGITLSQPLGDTNVLIKAPGAGGVRIENQTGILTDWRGYAVMPYATVYRYNRIALDTNTMGNSIDVEKNISSVVPTQGALVRANFDTRIGVRVLITVTQGGKPVPFGSLVRENSTGITSMVGDDGQVYLSGAPLSGELLVQWGDGANSRCIAHYVLPKQSLQQAVTVISAVCTHPGS

SEQ ID NO: 23083 - protein, 360 aa, Escherichia coli STEC_DG131-3; identical to SEQ ID NO: 8317

SEQ ID NO: 23084 - protein, 184 aa, Escherichia coli STEC_DG131-3; identical to SEQ ID NO: 12784

SEQ ID NO: 23085 - protein, 193 aa, Escherichia coli STEC_DG131-3; identical to SEQ ID NO: 6300

SEQ ID NO: 23086 - protein, 243 aa, Escherichia coli STEC_DG131-3
MTFMKGLPLLLLVASLCSHAALQPDRTRIVFNANDKATSLRVDNRSDKLPYLAYSWLENEKGEKSDDLLVALPPIQRLEPKATTQVRIVKQASTTKLPGDRETLFFYNMREIPPAPEKNSDHAVLQVAIQSRIKVFWRPAALRKKAGEKVELQLQVSQQGNQLTLKNPTAYYLTIAYLGRNEKGVLPCFKTVMVAPFSTVNTNTGNYSGSQFYLGYMDDYGALRMTTLNCSGQCHLQAVEAKK

SEQ ID NO: 23087 - protein, 816 aa, Escherichia coli STEC_DG131-3
MNIYRLSFVSCLVVAMPCALAVEFNLNVLDKSMRDRIDISLLKEKGVIAPGEYFVSVAVNNNQISNGQKINWHKNDDKTIPCINDLLVDKFGLKPEVRQSLPLINHCVDFSSRPEMLFNFDQASQQLNITIPQAWLAWHSENWTPPSTWKEGVAGILMDYNLFASSYRPQDGSSSTNLNAYGTAGINTGAWRLRSDYQLNQTDSDDNHEQSGEISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLLSGDDYHSAAIGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTTHRMSWNDTLDERNSWGMSAGLQSDRPDNGAQVSGNYQHLSSAGEWDISGTYAANDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQKFTVVWGDSQHCSLHLPEHMEDTANRLILPCH

SEQ ID NO: 23088 - protein, 430 aa, Escherichia coli STEC_DG131-3; identical to SEQ ID NO: 5758

SEQ ID NO: 23089 - protein, 331 aa, Escherichia coli STEC_DG131-3; identical to SEQ ID NO: 6456

SEQ ID NO: 23090 - protein, 760 aa, Escherichia coli STEC_DG131-3; identical to SEQ ID NO: 6415

SEQ ID NO: 23091 - protein, 614 aa, Escherichia coli STEC_DG131-3; identical to SEQ ID NO: 6242

SEQ ID NO: 23092 - protein, 695 aa, Escherichia coli STEC_DG131-3; identical to SEQ ID NO: 6243

SEQ ID NO: 23093 - protein, 203 aa, Escherichia coli STEC_DG131-3; identical to SEQ ID NO: 6414

SEQ ID NO: 23094 - protein, 361 aa, Escherichia coli STEC_DG131-3; identical to SEQ ID NO: 7868

SEQ ID NO: 23095 - protein, 224 aa, Escherichia coli STEC_DG131-3; identical to SEQ ID NO: 7869

SEQ ID NO: 23096 - protein, 606 aa, Escherichia coli STEC_DG131-3
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGVSWNYSKSRGQPDADQVFALNFSLPLNLLLPRSNDSYTRKKITPG

SEQ ID NO: 23097 - protein, 128 aa, Escherichia coli STEC_DG131-3; identical to SEQ ID NO: 7871

SEQ ID NO: 23098 - protein, 191 aa, Escherichia coli STEC_DG131-3; identical to SEQ ID NO: 5748

SEQ ID NO: 23099 - protein, 232 aa, Escherichia coli STEC_DG131-3; identical to SEQ ID NO: 5747

SEQ ID NO: 23100 - protein, 729 aa, Escherichia coli STEC_DG131-3; identical to SEQ ID NO: 6336

SEQ ID NO: 23101 - protein, 213 aa, Escherichia coli STEC_DG131-3; identical to SEQ ID NO: 5744

SEQ ID NO: 23102 - protein, 207 aa, Escherichia coli STEC_DG131-3
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDNQYRLSEITYSQNGKNWKVVYGGYDTKTQPAMPANMELTDGGQRIKLKMDNWIVK

SEQ ID NO: 23103 - protein, 87 aa, Escherichia coli STEC_DG131-3; identical to SEQ ID NO: 6040

SEQ ID NO: 23104 - protein, 646 aa, Escherichia coli STEC_DG131-3; identical to SEQ ID NO: 7882

SEQ ID NO: 23105 - protein, 539 aa, Escherichia coli STEC_DG131-3; identical to SEQ ID NO: 6525

SEQ ID NO: 23106 - protein, 353 aa, Escherichia coli STEC_DG131-3
MNERELSIIRALGEEFSAVLADLKRTFEGKIAAQAQTFEEKLASLSVVLQKCVTGDDVRPMLEQMVKEAVSHIPVPRDGRDYDPDVLQKAVNDAVGKIPVPANGKSITPDDVRPMIEQMVKEAVSHIPVPRDGRDYDPDVLQKAVNDAVGKIPVPANGKSITPDDVRPMIEQMVKEAVSHIPVPRDGRDYDPEVLQKAVLDAVSALPAPQDGRDATALEIHPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTGDKPGEAHSLAWTLAAKRGRDAGGGK

SEQ ID NO: 23107 - protein, 381 aa, Escherichia coli STEC_DG131-3
MTVALSAVAVAVMFAAGAQAAEVYNKDGNKLDLYGRATALHYFSDDKGNDGDQTYARLGFKGETQINDQLTGFGQWEYQFSGNKTESEGSAGNKTRLAFAGLRFADVGTIDYGRNYGIAYDVGSYTDVLPEFGGDGWTQTDNFMTARTSGVLTYRNTDFFGLVDGLNFAAQYQGKNERDDLQKANGDGYGFSASYEFDGFGFVAAYTKSDRTDKQVQGLNGTADVLDPASGKKVGEKAVDSGSVAKGKHAEFWGTGLKYDANNLYLAAVYSETQNMTTFGDQGVADKAQNIEAVVQYQFDFGLRPSLAYLQSRGQDVMVGGVNHGDQDLVKYIDVGATYYFNKNMSTYVDYKINLIDESEFTRKAGVATDNIVAVGMTYQF

SEQ ID NO: 23108 - protein, 236 aa, Escherichia coli STEC_DG131-3; identical to SEQ ID NO: 6472

SEQ ID NO: 23109 - protein, 404 aa, Escherichia coli STEC_DG131-3
MSVVVSGTLKSPDGEAISGANITLTALTVSPDALSGTSASAVTREGGYYGMTMDPGEYAVSVTVKGKTAVYGRVRIEGTESTVTLNMLLRRSLVEVSIPGELLTDFRQIQNNVADDLATIRRLNEDTATKNTQATQSKESAAASAKSASDSAKTATSRAAEAGQKATDATEAATRAITAAGNAEESSTRAGESEKAAGADAEKARQHAEKARLAQESAGEILKRAEAATVSAEEARRMAENARGPRGPQGETGPKGDVGPKGETGPVGPQGPAGPKGERGDVGAQGAVGPAGPRGEKGEQGERGPQGIPGLKGDTGERGPKGDQGDMGPKGEKGDPGGPAGPQGPKGERGEAGPQGPMGARGERGETGPRGEPGPAGPRGERGETGPSGTSWRARSGRQRCKCG

SEQ ID NO: 23110 - protein, 61 aa, Escherichia coli STEC_DG131-3; identical to SEQ ID NO: 11399

SEQ ID NO: 23111 - protein, 111 aa, Escherichia coli STEC_DG131-3; identical to SEQ ID NO: 8676

SEQ ID NO: 23112 - protein, 130 aa, Escherichia coli STEC_DG131-3; identical to SEQ ID NO: 7726

SEQ ID NO: 23113 - protein, 387 aa, Escherichia coli STEC_DG131-3; identical to SEQ ID NO: 7356

SEQ ID NO: 23114 - protein, 826 aa, Escherichia coli STEC_DG131-3; identical to SEQ ID NO: 13157

SEQ ID NO: 23115 - protein, 224 aa, Escherichia coli STEC_DG131-3; identical to SEQ ID NO: 6302

SEQ ID NO: 23116 - protein, 341 aa, Escherichia coli STEC_DG131-3; identical to SEQ ID NO: 13017

SEQ ID NO: 23117 - protein, 828 aa, Escherichia coli STEC_DG131-3; identical to SEQ ID NO: 7891

SEQ ID NO: 23118 - protein, 162 aa, Escherichia coli STEC_DG131-3; identical to SEQ ID NO: 6365

SEQ ID NO: 23119 - protein, 374 aa, Escherichia coli STEC_DG131-3; identical to SEQ ID NO: 5608

SEQ ID NO: 23120 - protein, 200 aa, Escherichia coli STEC_DG131-3; identical to SEQ ID NO: 6311

SEQ ID NO: 23121 - protein, 274 aa, Escherichia coli STEC_DG131-3; identical to SEQ ID NO: 9114

SEQ ID NO: 23122 - protein, 250 aa, Escherichia coli STEC_DG131-3; identical to SEQ ID NO: 6317

SEQ ID NO: 23123 - protein, 880 aa, Escherichia coli STEC_DG131-3
MPDHSLFRLRILPWCIALAMSGSYSSVWAEDDIQFDSRFLELKGDTKIDLKRFSSQGYVEPGKYNLQVQLNKQPLAEEFDIYWYAGEDDASKSYACLTPELVAQFGLKEDVAKNLQWSHDAKCLKSGQLEGMEIKADLSQSALVISLPQAYLEYTYPDWDPPSRWDDGISGIVADYSINAQTRHEENGGDDSNEISGNGTVGVNLGPWRVRADWQTNYQHTRSNDDDEFSGDETQKKWEWSRYYAWRALPSLKAKLALGEDYLRSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGEFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSGMVRTGNDKEMYTATYNQNFRDAGVSVYLNYTRHTYWDREEQTNYNIMLSHYFNMGSIRNVSISMTGYRYEYDNREDKGMYISLSMPWGDNSTVSYNGNYGSGTDSSQVGYFSRVDDATHYQLNVGTSDKHTSVDGYYSHDGSLAQVDLSANYHEGQYTSAGLSLQGGATLTAHGGALHRTQNMGGTRLLIDADGVADVPVEGNGAAVYTNMFGKAVVSDVNNYYRNQAYIDLNRLPENAEATQSVVQATLTEGAIGYRKFAVISGQKAMAVLRLQDGSHPPFGAEVKNDNEQTVGLVDDDGNVYLAGVKPGEHMSVFWSGVAHCDINLPDPLPADLFNGLLLPCQHKGNVAPVVPDDIKPVIQEQTQQVTPTNPPVSVSANQ

SEQ ID NO: 23124 - protein, 518 aa, Escherichia coli STEC_DG131-3; identical to SEQ ID NO: 7565

SEQ ID NO: 23125 - protein, 432 aa, Escherichia coli STEC_DG131-3; identical to SEQ ID NO: 5727

SEQ ID NO: 23126 - protein, 360 aa, Escherichia coli STEC_DG131-3; identical to SEQ ID NO: 6702

SEQ ID NO: 23127 - protein, 613 aa, Escherichia coli STEC_DG131-3
MFWRDITLSVWRKKTTGLKTKKRLLPLVLAAALCSSPVWAEEATFTANFKDTDLKSFIETVGANLNKTIIMGPGVQGKVSIRTMTPLNERQYYQLFLNLLEAQGYAVVPMENDVLKVVKSSAAKVEPLPLVGEGSDNYAGDEMVTKVVPVRNVSVRELAPILRQMIDSAGSGNVVNYDPSNVIMLTGRASVVERLTEVIQRVDHAGNRTEEVIPLDNASASEIAHVLESLTKNSGENQPATLKSQIVADERTNSVIVSGDPATRDKMRRLIRRLDSEMERSGNSQVFYLKYSKAEDLVDVLKQVSGTLTAAKEEAEGTVGSGREIVSIAASKHSNALIVTAPQDIMQSLQSVIEQLDIRRAQVHVEALIVEVAEGSNINFGVQWASKDAGLMQFANGTQIPIGTLGAAISQAKPQKGSTVISENGATTINPDTNGDLSTLAQLLSGFSGTAVGVVKGDWMALVQAVKNDSSSNVLSTPSITTLDNQEAFFMVGQDVPVLTGSTVGSNNSNPFNTVERKKVGIMLKVTPQINEGNAVQMVIEQEVSKVEGQTSLDVVFGERKLKTTVLANDGELIVLGGLMDDQAGESVAKVPLLGDIPLIGNLFKSTADKKKT

SEQ ID NO: 23128 - protein, 822 aa, Escherichia coli STEC_DG131-3; identical to SEQ ID NO: 7370

SEQ ID NO: 23129 - protein, 249 aa, Escherichia coli STEC_DG131-3; identical to SEQ ID NO: 6450

SEQ ID NO: 23130 - protein, 94 aa, Escherichia coli STEC_DG131-3; identical to SEQ ID NO: 10697

SEQ ID NO: 23131 - protein, 721 aa, Escherichia coli STEC_DG131-3
MDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYTFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDENNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDETGQQSIVDEGGILYLSGISSKSQSWTVRWGNQADQQCQFAFSTPDSEPTTSVLQGTAQCH

SEQ ID NO: 23132 - protein, 678 aa, Escherichia coli STEC_DG131-3
MVPSTFSRLKAARCLPVVLAALIFAGCGTHTPDQSTAYMQGTAQADSAFYLQQMQQSSDDTRINWQLLAIRALVKEGKTGQAVELFNQLPQELNDAQRREKTLLAVEIKLAQKDFAGAQNLLAKITPADLEQNQQARYWQAKIDASQGRPSIDLLRALIAQEPLLGAKEKQQNIDATWQALSSMTQEQANTLVINADENILQGWLDLQRVWFDNRNDPDMMKAGIADWQKRYPNNPGAKMLPTQLVNVKAFKPASTNKIALLLPLNGQAAVFGRTIQQGFEAAKNIGTQPVAAQVAAAPAADVAEQPQPQTVDGVASPAQASVSDLTGEQPAAQPVPVSAPATSTAAVSAPANPSAELKIYDTSSQPLSQILSQVQQDGASIVVGPLLKNNVEELLKSNTPLNVLALNQPENIENRVNICYFALSPEDEARDAARHIRDQGKQAPLVLIPRSSLGDRVANAFAQEWQKLGGGTVLQQKFGSTSELRAGVNGGSGIALTGSPITPRATTDSGMTTNNPTLQTTPTDDQFTNNGGRVDAVYIVATPGEIAFIKPMIAMRNGSQSGATLYASSRSAQGTAGPDFRLEMEGLQYSEIPMLAGGNLPLMQQALSAVNNDYSLARMYAMGVDAWSLANHFSQMRQVQGFEINGNTGSLTANPDCVINRKLSWLQYQQGQVVPAS

SEQ ID NO: 23133 - protein, 385 aa, Escherichia coli STEC_DG131-3; identical to SEQ ID NO: 9958

SEQ ID NO: 23134 - protein, 654 aa, Escherichia coli STEC_DG131-3
MNVIRTVICTLIILPVGLQAATSHSSMAKDTITVVATGNQNTVFETPSMVSVITNDTPWSQNAVTSAGMLKGVAGLSQTGAGRTNGQTFNLRGYDKSGVLVLVDGVRQLSDMAKSSGTYLDPALIKRIEVVRGPNSSLYGSGGLGGVVDFRTADAADFLPPGETNGVSLWGNIASGDHSTGSGLTWFGKTGKTDALLSVIMRKRGNIYQSDGERAPNKEKPAALFAKGSVSITDSNKAGASLRLYQNNTTEPGNPTLTHGDNGLRDRKTAQNDVQFWYQYSPADNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSNPVNIIVGSRYDRYKSFNPRAGKLKAERLSPRAAISVSPTDWLMMYGSISSAFRAPTMAEMYRDDVHFYRKGKPNYWVPNLNLKPENNITREIGAGIQLDGLLTDNDRLQLKSGYFGTDARNYIATRVDMKRMRSYSYNVSRARIWGWDMQGNYQSDYFDWMLSYNRTESMDASSREWLGSGNPDTLISDISIPVGHGGVSAGWRAELSAAATHVKKGDPHQAGYAVHSFSLSYKPVSVKGFEASVTLDNAFNKLAMNGKGVPLSGRTVSLYTRYQW

SEQ ID NO: 23135 - protein, 130 aa, Escherichia coli STEC_DG131-3; identical to SEQ ID NO: 9060

SEQ ID NO: 23136 - protein, 208 aa, Escherichia coli STEC_DG131-3; identical to SEQ ID NO: 5717

SEQ ID NO: 23137 - protein, 416 aa, Escherichia coli STEC_DG131-3
MLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYSYDNRTNYDAYYSPGSPLLDTRKLYSQSWDAGLRYNGELIKSQLITSYSHSKDYNYDPHFGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRIVRIS

SEQ ID NO: 23138 - protein, 152 aa, Escherichia coli STEC_DG131-3
MIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 23139 - protein, 445 aa, Escherichia coli STEC_DG131-3; identical to SEQ ID NO: 9001

SEQ ID NO: 23140 - protein, 170 aa, Escherichia coli STEC_EH250 [sequence omitted]

SEQ ID NO: 23141 - protein, 865 aa, Escherichia coli STEC_EH250; identical to SEQ ID NO: 6375

SEQ ID NO: 23142 - protein, 246 aa, Escherichia coli STEC_EH250; identical to SEQ ID NO: 6964

SEQ ID NO: 23143 - protein, 747 aa, Escherichia coli STEC_EH250; identical to SEQ ID NO: 6343

SEQ ID NO: 23144 - protein, 266 aa, Escherichia coli STEC_EH250; identical to SEQ ID NO: 5772

SEQ ID NO: 23145 - protein, 161 aa, Escherichia coli STEC_EH250; identical to SEQ ID NO: 5769

SEQ ID NO: 23146 - protein, 221 aa, Escherichia coli STEC_EH250; identical to SEQ ID NO: 8014

SEQ ID NO: 23147 - protein, 351 aa, Escherichia coli STEC_EH250; identical to SEQ ID NO: 6367

SEQ ID NO: 23148 - protein, 222 aa, Escherichia coli STEC_EH250; identical to SEQ ID NO: 15607

SEQ ID NO: 23149 - protein, 869 aa, Escherichia coli STEC_EH250; identical to SEQ ID NO: 12649

SEQ ID NO: 23150 - protein, 746 aa, Escherichia coli STEC_EH250; identical to SEQ ID NO: 6710

SEQ ID NO: 23151 - protein, 193 aa, Escherichia coli STEC_EH250; identical to SEQ ID NO: 6300

SEQ ID NO: 23152 - protein, 242 aa, Escherichia coli STEC_EH250; identical to SEQ ID NO: 6420

SEQ ID NO: 23153 - protein, 815 aa, Escherichia coli STEC_EH250; identical to SEQ ID NO: 6927

SEQ ID NO: 23154 - protein, 430 aa, Escherichia coli STEC_EH250; identical to SEQ ID NO: 5758

SEQ ID NO: 23155 - protein, 342 aa, Escherichia coli STEC_EH250
MSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTGRTTGVATYRNNDFFGLVDGLNFAAQYQGKNDRTDVTEANGDGFGFSTTYEYEGFGVGATYAKSDRTNNQVIYGNNSLNASGQNAEVWAAGLKYDANNIYLATTYSETQNMTVFGNNHIANKAQNFEVVAQYQFDFGLRPSVAYLQSKGKDLGAWGDQDLVEYIDVGATYYFNKNMSTFVDYKINLIDKSDFTKASGVATDDIVAVGLVYQF

SEQ ID NO: 23156 - protein, 331 aa, Escherichia coli STEC_EH250; identical to SEQ ID NO: 6551

SEQ ID NO: 23157 - protein, 760 aa, Escherichia coli STEC_EH250; identical to SEQ ID NO: 6415

SEQ ID NO: 23158 - protein, 203 aa, Escherichia coli STEC_EH250; identical to SEQ ID NO: 6414

SEQ ID NO: 23159 - protein, 361 aa, Escherichia coli STEC_EH250; identical to SEQ ID NO: 7868

SEQ ID NO: 23160 - protein, 224 aa, Escherichia coli STEC_EH250; identical to SEQ ID NO: 7705

SEQ ID NO: 23161 - protein, 580 aa, Escherichia coli STEC_EH250
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISGTTVSPVVNLMLIRCLL

SEQ ID NO: 23162 - protein, 229 aa, Escherichia coli STEC_EH250; identical to SEQ ID NO: 7707

SEQ ID NO: 23163 - protein, 557 aa, Escherichia coli STEC_EH250
MTREGGYYGMTMDPGEYAVSVTVKGKTAVYGRVRIEGTESTVTLNMLLRRSLVEVSIPGELLTDFRQIQNNVADDLATIRRLNEDTATKNTQATQSKESAAASAKSASDSAKTATSRAAEAGQKASEAAEAATRAGESEKAAAADAKNAKQHAETARVAQQAAGDILERAEAATVSAEEARRMAENARGPQGDQGPKGDTGPRGEKGEPGQRGPQGPKGERGERGPQGSVGPAGPRGEKGEQGERGPQGLQGLKGETGERGAQGAQGPAGPTGATGPAGPRGETGPQGAQGPAGATGPVGPQGERGIQGPAGPAGPRGETGARGEKGDPGDPGGPPGPKGDTGPAGPAGEKGEPGERGPQGLQGPPGPAGERGPAGEPGAKGETGKPGPAGPQGQPGPQGLKGDRGEPGPTGPQGPAGERGPQGPRGVAGPVGPAGAAGAKGDAGPAGPAGPRGPAGERGPAGPKGERGEPGPMGPPGPAGDAGNSTVKGIRLGNEMVYRPYSGYSNLSLRSMDGCVLTGIAGTNMPDKSRIDEIYYRPLQMTFGDGSWRSVGIGEV

SEQ ID NO: 23164 - protein, 729 aa, Escherichia coli STEC_EH250; identical to SEQ ID NO: 6402

SEQ ID NO: 23165 - protein, 213 aa, Escherichia coli STEC_EH250
MTKMSRYALITALAMFLAGCVGQREPAPVEEVKPASEQPAEPQQPVPTVPSVPTIPQQPGPIEHEDQTAPPAPHIRHYDWNGAMQPMVSKMLGADGVTAGSVLLVDSVNNRTNGSLNAAEATETLRNALANNGKFTLVSAQQLSMAKQQLGLSPQDSLGTRSKAIGIARNVGAHYVLYSSASGNVNAPTLQMQLMLVQTGEIIWSGKGAVSQQ

SEQ ID NO: 23166 - protein, 517 aa, Escherichia coli STEC_EH250; identical to SEQ ID NO: 6406

SEQ ID NO: 23167 - protein, 191 aa, Escherichia coli STEC_EH250; identical to SEQ ID NO: 5748

SEQ ID NO: 23168 - protein, 232 aa, Escherichia coli STEC_EH250; identical to SEQ ID NO: 5747

SEQ ID NO: 23169 - protein, 203 aa, Escherichia coli STEC_EH250; identical to SEQ ID NO: 6396

SEQ ID NO: 23170 - protein, 565 aa, Escherichia coli STEC_EH250; identical to SEQ ID NO: 8030

SEQ ID NO: 23171 - protein, 207 aa, Escherichia coli STEC_EH250; identical to SEQ ID NO: 5743

SEQ ID NO: 23172 - protein, 407 aa, Escherichia coli STEC_EH250
MTERELSIIRALGEEFSAVLADLQRTFEGKIAAQAQTFEEKLASLSVVLQKCVTGDDVRPMLEQMVKEAVSHIPVPRDGRDYDPDVLQKAVNDAVGKIPVPANGKSITPDSVRPMIEQMVKEAVSHIPVPRDGRDYDPDVLQKAVNDAVANIPQPADGKSLTPDDVRPMLEQMVKEAVSHIPVPRDGRDYDPEVLQKAVNDAVANIPQPADGKSITPDDVRPMLEQMVKEAVSHIPVPRDGRDYDPDVLQKAVLDAVSALPAPQDGRDATALEILPAIDDQKSFPRGTYATHQGGLWRAYEKTHGMRGWECLVDGVADIDVSMTGERLFSVVVRQSSGQRTEKTFSLPVMLYRGVFRAGETYHPGDTVTWGGSLWHCNSMTGDKPGEAHSSGWALAAKRGRDAGGGK

SEQ ID NO: 23173 - protein, 381 aa, Escherichia coli STEC_EH250; identical to SEQ ID NO: 23107

SEQ ID NO: 23174 - protein, 539 aa, Escherichia coli STEC_EH250; identical to SEQ ID NO: 6391

SEQ ID NO: 23175 - protein, 646 aa, Escherichia coli STEC_EH250
MRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 23176 - protein, 102 aa, Escherichia coli STEC_EH250; identical to SEQ ID NO: 6385

SEQ ID NO: 23177 - protein, 537 aa, Escherichia coli STEC_EH250
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYSWDIGVFRLDFSVPQAWVEELESGYVPPENWERGINAFYTSYYVSQYYSDYKASGNNKSTYVRFNSGLNLLGWQLHSDASFSKTNNNPGVWKSNTLYLERGFAQLLGTLRVGDMYTSSDIFDSVRFSGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDFAAGRSHIEGASKQSDFVQAGYQYGFNNLLTLYGGSMVANNYYAFTLGTGWNTRIGAISVDATKSHSKQDNGDVFDGQSYQIAYNKFVSQTSTRFGLAAWRYLSRDYRTFNDHVWANNKDNYRRDKNDIYDIADYYQNDFGRKNSFSANMSQSLPEGWGSVSLSTLWRDYWGRSGSSKDYQLSYSNNWRRVMTRTY

SEQ ID NO: 23178 - protein, 205 aa, Escherichia coli STEC_EH250
MVIFGTRIIYPAEQKEVMVQLMNQGNRSSLMQAWIDDGDTSLPPEKIQVPFMLTPPVVKVAANSGQQIKIKIMPNKLPSNKESIFYLNVLDIPPNSPEQEGKNALKFAMQNRIKLFYRPAGIAPVNKATFKKLLINRSGNGLVIKNDSANWVTISDVKANNVKVNYETIMIAPLESQSVNVKSNNANNWYLTIIDDHGNYISDKI

SEQ ID NO: 23179 - protein, 118 aa, Escherichia coli STEC_EH250 [sequence omitted]

SEQ ID NO: 23180 - protein, 673 aa, Escherichia coli STEC_EH250; identical to SEQ ID NO: 6170

SEQ ID NO: 23181 - protein, 341 aa, Escherichia coli STEC_EH250; identical to SEQ ID NO: 12815

SEQ ID NO: 23182 - protein, 828 aa, Escherichia coli STEC_EH250; identical to SEQ ID NO: 6366

SEQ ID NO: 23183 - protein, 162 aa, Escherichia coli STEC_EH250; identical to SEQ ID NO: 6365
